United States Patent 11,118,159 (COMPOSITIONS AND METHODS FOR PROVIDING PLANTS WITH TOLERANCE TO ABIOTIC STRESS CONDITIONS) - sequence listing, part 2

SEQ ID NO: 2 - DNA, 703280 bp, Enterobacter sp SA187
ctggcggcactagcgcggcggtcccacctgaccccatgccgaactcagaagtgaaacgccgtagcgccgatggtagtgtggggtctccccatgcgagagtagggaactgccaggcatcaaattaagcgtgctgatatggctcagttggtagagcgcacccttggtaagggtgaggtccccagttcgactctgggtatcagcaccacttttaaagcggttaatagttcggcacttagaaaagaatttgcctggcgacactagcgcggcggtcccacctgaccccatgccgaactcagaagtgaaacgccgtagcgccgatggtagtgtggggtctccccatgcgagagtagggaattgccaggcatcaaataaagcaaaaagcccagtcgaaagactgggctttttgctatggatcttttctggaaataaccgcaaagcctggcgcggcggctgggctttgcggttatagaagccagattaatgaataacctgcgacaaaaatgctcttgtacgttctgatttggggttggcaaagaaggtttctggcggtgcctgttcaacgatttcaccacgatccataaagatcacgcgatccgctacggtacgggcaaagcccatctcatgggtcacgcagagcatggtcatacccgactcggcaaggccaatcatcgtatccagcacctctttcaccatctccgggtcgagcgcagaagtcggttcgtcgaacagcatgattttcggtttcatacacagcgaacgagcaatggctacgcgctgttgctgcccgccggaaatctgccccggaaatttatgggcatgttcagcaatacgcacgcgttcaagataatgcatcgccagtgcttccgcttccttcttcggcattttacgcacccagatcggtgccagcgtgcagttctgtaaaaccgtcagatgcgggaacaggttgaaatgctggaacaccatgcccacttcctgacgcaccttttcgatattacggatgtcctcgttaagctcaatcccatccaccacaatccggccttgctgatgctcttccagatggttgatacagcggatcgtggtggatttccctgaacccgacggcccgcagaggacaatacgttcaccctgtttgacctcaaggttgatatttttcagcacgtgaaactgcccgtaccatttattcacagtgtcgagcgtaatcatcgcatcgtcagactgcataatcatattactcatggttttcctcagtgcgctgtacgcccggtgttgaaacgcttctccagatgctggctgtagcgtgacatgctaaaacagaaaatccagtaaaccagcgcggcaaagacatagccctcggtcgacatgccaagccatgccggatcgaccgtggcctgctgcacgctgctgaacagatcaaaaagcccgatgatgatcaccagactggtatctttaaatagcgcgataatggtattaaccagacccgggatcaccagtttcagcgcctggggcaatatgaccagcccctgtgttttccagtaaccaagggccagcgattccgccgcttcatactgacccttcggcaatgcctgaagcccgccgcgtaccacttccgccacataagccgactgaaaaagcaccacgccaaccagcgcacggatgagcttatctatgcttgttccttcagacataaacagcggcagcattactgacgacataaacagcacggtaatcagcggcacgccacgccagaactcgataaatatcaccgacaggatccgcaccactggcatttttgaacgccgccccaaggccagtaagatgcccaacggcaaagcaccggcgataccgaccgcggcgatgattagcgtcagcgttaatccgccccattgacgggtttccacccgctcaagccctaaaaatcctccatacaacaaccaccacaccacgaccggatagataactgcccagcaggcgatataacggccacgcctgggcagtgttttcaaaaacatcggcgcgatagagagcagaccaaagattaaggcaacattgatccgccagcgctgctcatgggggtaaaggccatacataaactgcccaaaccgctgatggataaatacccagcaggcgccttccttcgtacaatccgcgcgggtcgttcccacccagtttgcctggaataacacccagttaagcaatggcgggatcagctcccacatcagccacaggcagaacagcgtcagcagtgtgtttgaccagctggagaaaaggttcttacgtacccaaagtaaataatgccccgtcccggtactgaccggacgcggcgagtgagacacaatagcttttgtcatcacggatccttagcgttcaatcagcgcaatgcggcggttatagatattcatcagcaacgaaataccgagactgataatcaggtataccgacatagtgatggcgatagtttcaattgcctggcctgtctggttcaggacggttcccgcgaaaagcgacaccatgtccggataaccaatcgccgccgccagagatgagtttttgacgatattaagatactggctggttaatggcgggatgatcacacgcagcgcctgcgggatgatcacctggcgtagcgttaccggatgcggcaggccaagcgaacgcgccgcttcgtgctgcccgtgcggtactgactgaatacccgcgcggataatctcggcaataaaggcggaggtatagactgacagggccagcgtcaatgctgccagttccgggatcagcgccattccgccacggaagttaaaaccgcgcagttccggcacatcccagtgcagggccgccccgaaaatcatgtgcgccagcagtggcaatgcgatgaaaagaccaagtgcaaccggccatgtgcggcgtagttgcccggttttgatctgatgcgttttattaaagcggaacaggccaaccgacaggacaactgccagcgcgactgccgcgataaaagccagcagcccttcacctgtttgcggcgcgggaatatagagaccacgattgctcaaaaacgccaggtcgaacgcgcttaccgcctggcgtggccccggaagattacgcagtaccgcaaagtaccagaagaagatctgtaataacggcggaatattgcggaacgtctcgatgtaaatagtcgacagtttacgcagcagccagttttccgacagtcgtgcaagccccagaaagaagcccagaaatgaggcaaaaacaatgcatagcgccgataccagcagcgtattaagcaaaccgaccaggaacacccggccataagtatcgccctgctcataatcgataagatgctgaacaatgccgaaaccggcgctgcgatcgaggaaggcaaaacctgacgtgatgccacggttgctcagattggtaacggtattgtgtatcaggtaaatagccacgccgacgacagccagcacggcgataatctgaaacagccaggcgcgaaccgcagggttggagaaggaaaacgatcctttaacggttgggcggcgatgggacataagaaaacctcggtagccatgactctggaccggacaccgcaaaggcggtgtccgttactgcaaaatacaaaatgtcaggtcttaacgtactggcggagcgtactgaataccgccgttattccagaggttgttctgaccacgtttgattttcagtgggctttcagaacccacattacgttcgaacacttccgcatagttaccgactttcttgatgatgttataagcccatttgttatcaagcttcagatccttgccgtaatcaccctctttgcccagcagatgcgccatatcaggcgtggccggattcgccgctttctcatcgacgtttttagaggtaacacccatctcttccgcattcagcatggcgaacagcgtccagcgcacaatggagaaccactcatcatcaccgcggcgaaccaccgggcccagcggctctttagaaatcacttccggcagaacaatccactcgcccggcgtgctcagcttaatgcgcagcgcatagagctgagactggtcggaggccagcgtatcgcaacgacctgattccagcgccttggcggattcatcagaacggtcaaaggtcaccggcgtatagttcattttgttggatttgaaataatccgccacgttcagctcggtgtctgtacctgcctgaatacagacggtggcaccatccagctctttggcgcttttaaggcccgctttgttgtgggtcaggaagccgataccgtcatagtaggtgacgccggtaaaggacattcccatgcctgcatcacgggaggaggtccaggtcgtattacgggagagtacatccacttcacccgactgcaacgcagtgaagcgctcttttgccgtcagcggggtatattttacttttgtatcatcgccgaaaacggcagccgcaacgccacggcacacatccacatcaataccgctaaatttaccgttggcgtctgcataagagaaacccggcaacccgtcactaataccgcactgcacaaaaccttttttctttactgcatccagagtggcaccagcatgggcctgattagcaacagcaaacagcgcaccggcagcggccaggctggcgatcatcatctttttcataatgcatcctgtgtggcgaaattatcgttatatgaaggcgtccgggaaacgcctgaaacctgtctgtggctttggccatactttgtaaagcaaaggtagtgccaggttttacgtgcgaaaagaattaatgcagaacgcccgtaataaggagagtgtagacagggaaaaataaaatcagcgcactggattggtgcgaaattaaaacctgtgccacaaatcagagcaaaataaattcatagcagacgaaccattggtgggatgaatcatttatacaggaaagggggaagaaaataatgacccaaagtaagagataattttaacaatgttgatggattgcaccggacgggagcaaaagcaggcgtacaccggcacgcctgcgagaagattatttggtgagagcgacgatacccagggtcacgccagcaatggccgcagcgccgcctgcgatagcgcctgccgtttcccagttatcctgcgtggtgcctttcatgcaggtattagtgtgcaccaggcggccctgatcgtcatagacggggacacaaggggaatcgtgagcacacccggccagtacggaagacaacagtgcaatggcaattaattttttcatgatcacaattacctcttttgtgtgaatgcgttcattctaccactggttagcacgccttcctgcggctggagttttacaaagcatgtcgaatgtaaaaagcgtggagataaagccgccagaatggtgagattatggagaaatagaggatgtgcgcagggacaatgatgtacatgagtgatggtttaccggcgcagagggcgtaaggcgaagcgatgccagcagtccgtccaccagcgacggagccagtctgtcgagatcaaagcttttgtccgtcatgagccagtttttgatgataccgctcaggtaggcctgaataataatcatcgccaggtctatattacagttcagaaaccctgggttttcttttaagcatttattcaacatctgcaaaacatgttcatgattaaacaacagacgctcgcgtatctctgtttctgatgtcagctcttttgtaaactcgcatttatggtaaagaatttccaccagcgcctgttccagcggatcctgagcaatcagccgtaaaccttctattagtgattgtcgtaatattatttcggcagatgcgtccgaatgtaacttcattttatcggctattttatccctcacaggtaattgttcttgccagatagcgttaaataattgtgatttattttcaaagtgccagtaaatagcgccgcgtgttacttgcgctgcatgggctatatcatccagcgatgtgccagagaatccttgttgagaaaaggttaaaatggcggtgtcaattaataattgccgtgtttttaaggcatcctctttcgttctttttgccatgaataataactatgctgaatgatgggttacatttgctaaatgaaatttccgcaaaaaattgaatttgtatccttgcatttttctactattcattcaacatgtcgaggctatttttattgccgtcctctttatattcatcgcataaatataaagagggatgtttttattttagtgctgacgcgggtcggtgaatgcgaacagatataaggtgaaccgctaccatggctaagttctttattgataggcctatattcgcctgggtgctggcgattattttaatgctggctggtgcgctggcggtcatcaaccttccggttgcacaatatcctacgatcgcaccgcctgctatcgctattaatgccacttatcccggcgctgatgcgcaaacggtccaggataccgttacccaggtgatagaacaaaatatgaatggcctggataacctgatgtatatgtcgtccaccagcgattctgccggcagcgtgtccgtcaccttaacctttaaatccggcaccgatgccgatatcgcccaggttcaggtccagaacaaactgcaacttgctatgccattattgccccaggaagtgcagcaacaggggataaacgttaagaaatcaagcagcacctttttgatggtaatgggttttatctcagaagacggcagcatgacgcaggatgatattgccgattttatctcgtcaaatattaaggatcccgttagccgtactgaaggggtgggcgacgtgcagctattcggcgcgcaatatgcaatgcgcatctggcttgatccgaacaaactgaatgaatatcagttgactactgtcgatgtggtcgatcagatcaaagcccagaatagccagattgccgcaggccagctgggcggcacgccatccgtggccaatcagcagattaacgcctcgatcattgcccagacgcgtctgcgtacgccggagcagtttggccgtattacgttaaaagtcctctccaacggcgcacgggtacagctcaaagacgtcgcacgcatcgagctgggcggcgagaactacaacgttatcgcccggtataacggtaaaccgtcagcgggtctgggcatcaaactcgcaacgggcgctaacgcgctggacgccgccgatgcggtgaaacagcagatggcccacctgcaaccctactttcctcacggcctgaaactggtttacagctacgacaccaccccctttattaagatctccatccgggaagtcttcaaaacgctgtttgaagccatcgtgctggtgtttcttgtcatgtatctgtttttgcagaatctgcgggccacgctcattcctactattgcggtgcccgtggtgttactggggacctttgccatactggcggcgttcggctattcgattaacacgctgaccatgtttggcatggtgttagccatcggcctgctggtggacgacgctatcgtggtggtggaaaacgtagagcgcgtgatggtcgatgaaggattgccccccaaagaggcgacgcagaaatcgatggcgcagatacagggcgcgctggtgggcatcgccatggtgttgtcggcggtattcgtcccgatggcgttttttggcggctcaaccggggtgatctaccggcaattctccatcaccatcgtttctgccatggctctgtccgtgctggtggcgctcattttaacgcccgcactgtgcgccaccctgctaaaacccactacccacggcacgactaaccggatgtttggctggttcaaccggctgtttgaacaaagcacccagcactacaccggcagcgtacagaaactgctaagccgtaccggccgctacatggtgctttacctggtgattgtcgtgggcatggcctgtttattcctgcgtttgcccacctcttttttacccgaagaggatcaaggggttttcctgacgatggtcacgctgcccgctggcgccgcccaggatcgcacggaaaaaatcatgcaggaagtcacacgttactatctgacgaatgagaaaaataacgtggattctgtgtttacggtgacgggctttgggcttaacggtaaagggcaaaacaacggcctggcttttatccgtttaacagactgggcacagcgtgaaggcgaggaaaaccgtgttgaggcgatagttgcgcgtgccacgcatgcgtttcgcagtatcaaagacgggatggtatttgcgtttaaccttcccgccattaccgagctgggcactgctaccgggttcgactttgaactgatcgatcaggcggggctggggcatgtggagttgaccaaagcgcgtaatgaactgctgaaaaaagtcgctcagcgtccggatatgctggtgcgtacacggcctaatggtctggaagatatgccgcaattcaaactgaatgtcgatcaggaaaaagcacaggcgctcggtgtctcgctaacggatatcaacaagaccattgcaaccgcactgggtagcacttacgtgaatgatttcgtcgataacggccgtgtgaaaaaagtttacgcacaggctgacgcgccttatcgcatgatgccggatgatattaaccgctggtttgtacgtagccgtaacggcgaaatggtgcccttttcaagtttcaccagcgccaactggatccagggatcgccacgtctggagcgctacaacggtttgccagcgatggaaattctgggtgaggccgcgccaggtaaaagcagcggtgaggccatgaagatgatggaggcgttcgccgcaacgctgccctccgggattggcttcgactggacggggatgtcgtatcaggagcgcttatccggcaatcaggcccccgcgttatatgccatctcactgatggtggtattcctgtgtctggcggcactttatgaaagctggtcgattccattttccgtcatgctggttgtaccgctcggcgtggtgggcgccttgctggcggccagttgccgtggcctgagtaacgacgtctatttccaggttggcctgctgaccaccattggattgtcggcaaagaatgccattttgatcgtcgagtttgccagggatttgatggataaagagcacaagagcttaatcgacgccacgctggaggcggtaaaaatgcgtttgcgcccgatactcatgacgtcactggcttttatccttggcgtaatgccgctggtgctcagtacaggcgcaggcagcggcgcacaaaacgcggttgggactggcgtaatgggcggtatggtatccgcaaccctgctggcaatattttttgtgccggtatttttcgtggttattcgccgacgctttaccagtaaccactaaatatattcactgaaattatttatataaatattcttatacaaggcgtttatatttaaaaggtgttatcgcgtcgcaaaggcgatatttacctcatggctttagttttaagtgccattatttgtggcttaggattcgacgtcatttacataaatagtgaattatttgtaggatacccgacccgctggttttatttttctacctgctttgcggcttatgccgcgcattgtgttttgaggaactgcaatgaataaatttggtgaatgtattcgcctttcatcagtcattattatgtcaatcggcttactttgcggttgtaatgataatgaaaacgcgccagctaaaatgccggatcccgaggtcagcgtctggcaggttaaagcagcccctctggcggtgacgacagaattaccgggacgaaccgaagcatttcgtattgcagaggtgcgtccgcaggtgagcggaattattctcaaacgtaattttgttgaaggcaacgatattaccgccggggactcgctgtatcagatcgatccggcaacctatcaggcggccttagcaagcgcgcagggcgaattagcgaaagccgaagccgctgcaagtatggcgcacttaacggtcaaacgttatgcgcctctggtagggacgcaatacgtcagccgtcaggaatatgacaccgccgttgccagcgcccggcaggcagacgccagcgtccaggccgcaaaagccgcagtagagacggcgcgtatcaatctggcctatacccgtgtcagttcccccatcagcggccgtatcggtaaatctgccgtcaccgaaggcgcgctggtaaccaacggtcaggcgacggcgctggccacggtgcagcaaatcgatccaatctatgttgatgtcacgcaatccagcagcgattttatgcgtctgaaacaggcggtggaacagggcaacctgcgcagacaggatggcaaagctgaggttgaactgctcacagagaacggtcaggtctatccgttaaagggtacgctggaattctcagatattaccgtcgaccagagcaccggctcgatcactatccgcgcggttttccccaatcctgatcacagcctccttccgggaatgtttgtgcgcgcacgccttgatgaaggtgttcagccagaagctattctggtgccgcagcagagcgtaacccgtaatgctcgcggcgatgccaccgtgatgctggtaaatgaaaaaaatcaggctgagcagcgcaacgtagttgcgactcaggctattggcgataaatggctcatttcggaggggctgaaagagggtgacaaggtgattgtcagcggcttgcagcgtgcccgtcctggcacccaagtgactatcgtgcctgcttcatcaggtgagtaaaaaacgcgttgcagtaatcgcgcttacgcagtgagagtcgtaaaagatgtcgaagttttttattgatcgtccgatttttgcctgggtgctgtcgatcatactgatgattgcgggtgtactggcaatcatgcaattacctgtggcgcagtatccaaccattgcaccgcctgcgatcgcaatcagcgcctcctacccgggggccgatgcgcaaacggtgcaggataccgtcacacaggttattgaacagaacatgaatggcatcgataacctgatgtacatgtcctcaaccagcgattccgcaggtggcgtaaccatcaccctgacctttaaatcagggactgaagcggatattgctcaggttcaggtgcagaacaagctacaactggcgatgccacttttgccgcaggaagtgcagcagcaggggatcagcgttgagaaagccagtagcagtttcctgatggtggtgggctttacctctgaaaacaaaagcctgaaccaggacgatatttctgactatgtcgcctctaacgttaaagatgccattagccgtaccaatggcgttggcgacgtacagcttttcggtgcgcagtatgcgatgcgtatctggctgaatgtcgacatgctcaataaatatcgtatgacgccggtggatgttgttaaccagctcaaagtgcaaaacgatcagattgccgccgggcagttgggtggaacgccttctgttcctaatcaacagctcaacgcctccatcattgcgcaaacgcgcctgaaagatccggagcaatttggtaacgtgacgctgcgcgtcaatgcggacggttcgcaggttcgcctgagagatgtggcccgcattgaactgggcggggaaaactataacaccgttacgaaaatcaacggtcaggatgcggcggcgataggtattaaactggcgacaggggcaaacgcccttgataccgcaagcgctatcaagaacaaattacaggagcttgctccttattttccgcagggtatgcaggttgtttatccgtatgacactacgcccttcgtgcagatttccattcacggagtgatcaaaaccctgttcgaagccatcatcctggttttcctggtgatgtacctgttcctgcaaaatatccgcgccacgctgatcccgaccatcgccgtgccggttgtgttgctgggcacctttgccgtcctctctgcttttggctattcgattaacacgctcaccatgttcgggatggtgctggcgatcggcctgctggtcgacgatgccattgtcgtcgtggagaacgttgagcgtgtgatggtagaagatcacctgccgccgagagaagccacccagaaatcaatggaacagatccagggcgcgctggtgggcatcgccatggtgctgtcggcggttttcattccaatggcattttttggcggttcaacgggtgaaatttatcgtcagttctcgatcactatcgtgtcagcaatggccctgtcggtactggttgcgctgattctcacgccggcgttatgcgccacgctgcttaagcccgtcgatccccatgcccatggtgataaaaaaggctttttcggctggttcaaccgtttgtttgaacgttgcaccagccattacaccgacagcgttggcggcattatcagaagtaccgggcgttacctgctggtgtatttcctgattgtggtgggcatggcggtgctgtttttacgcttaccgacgtcctttctgccggacgaagatcagggcgtctttatgaccatggtgcaactgccagccggggcaacccaggcacgtacgcagaaggtgctcgatcaggtgaccgattactacctgaacgatgaaaaagcgaacgtgaattcggtgctgacggtgaacggttttagtttcagcggtcaggggcagaactcgggaattgcctttatcagtcttaaaccatgggaagagcgtccaggtaaagaaaacgccgtagagggcattgtggcacgcgccactaaagccttcagccgtattcaggatggccaggtgtttccctttaacctgccgccgattgttgaacttggcacggcgacagggtttgacttcgagcttatcgatcaggccaaccttgggcatgatgcgctgacaaaagcacgtaaccagctgatggaaatggtacagcagcatcctgataaactggtgcgcgtacgacctaacggacttgaagataccccgcagttcaaacttgaagtggacattgaaaaagcccaggccttaggtatcgatctttctgatgttaatcagacgatctcaattgcgttggggggatcctacgttaatgacttcatcgatcatggacgcgtgaaaaaagtctacgttcaggccgatgcgaaattccgtatgctgccgggggatattaataatctctacgtgcgcagcagcaacggagaaatgacgcccttctcctcatttaccacctcaagttgggtttacggctcgccgcggctcgaacgctttaacggtctgccatctatggagatcctgggcgaggccgcccccggcaagagttcaggtgacgccatgctgttgatggaacaaatggcctcccggctgcccgccgggataggttacgactggacgggtatgtcatatcaggaacgtttgtccggcaaccaggcgcccgcgttatacgctatttcgctgatcgttgtcttcctgtgcctggcggcactctatgagagctggtcaatcccgttttccgtcatgctggtggtgccgcttggcgtgattggcgccttgctggcggcgatgatgcgcggcatgaataacgatgtctatttccaggtcggcctgttaaccactattggcctgtcggcgaaaaacgccattctgatcgtggagtttgccaaagatctgatggataaagaaggcaagggcgtgattgaagcgacgctggacgcggtgcgtatgcgtcttcgtccgatcctgatgacctcgctggcattcattctgggcgtcatgccgctggtgatcagctccggcgcaggcagcggtgcgcaaaacgccgtgggtaccggggtgctgggggggatgctgaccgccacgctgctggcgatcttctttgtgccggtattctttgtggtcgtacggcagtttttcacgaaaaaagccagataacggctaagcggccctggcctggttcacaggccggggcttttttattcgccagtacgacccaactgtgcggcttcctgagcggaaaccggcctgccgagcagaaaaccctgcagagtgttgcagcccagttctgtcaggaaggtctgctgcgcctcggtttccacaccttctgcgacaattttcagatccagcgttttcgccagcgctacaatggctgaaacgatggtcgcatcatcgccgtcaccgttaagctccttcacaaaagcacgatcaattttgagttcgcaggcgggcagacgtttcagatacaacaggctggagtagccggtaccaaaatcatcaatggacgctttgactccggcatgcgtaagctccgtcagaatacgcacgctctcttccggattgctcatcgccgtggtttcggtgacttcaaggatcagatcctccggcgccacctgatagcgttgcaggcagtccatcacgtgttccaccagtccgggttgctcgaattgcagggtggataaattgaccgccatcgaccatgaggtattccccaagagatgccattcccgcagctgccggcaggcctcatcgatcacccaattgccgataggaatgatcagcccggtcttttcggccagtggaagaaatacgtcaggggttaacagaccgcgcttactatgctgccagcgcagaagcgcttcaaagccgaccaccggtccggtgggggcatggaatttaggctgataaaccagacgtagctcgttacgctccagcgcctgccacaaatcattgaccagttgtaactgcgcctgcgccagcgtattcattgacggctggaaaaaatgatacccgttacgccccatgcgtttagtgtgatacatcgccgcatcggcattgaacatcaactcgcgctcattttcaccatcgtgaggaaaaagagcgataccgacactgagtgtgaccaccatttcatagggatcaagagtaaaaggacgatcaaccgcccgtaccagttcactggcaagcgacgcggcttcgtccggcgcgctgacttcagccagcaatacaaattcatcgccgccaatacgcgccagggtgtactggcctttaagcggatgcttcaggcgttcggtaacggcgatcagcaaccgatcccccacgtcgtgaccataggcatcgttcaccgctttaaagccgtccagatccataaacatcagggcaaaaaagctcccttcacgtctcgccttgcggatcgcctgatccagacggtcttccagcaatacgcggttaggtaaacgggtcaacgtatcatggagcgccagttgcgcaagctcgcggttggcctctgcaagcgataaggcaagcagagaagtgcgcgcctgtagtcgtgcatccagcatcgagaccagcagcgtgatccccagaatggaaagtgcgacaacgctgacaagaaccgccagccagttgccgttaacgccatcatgcatcatcgggtgctgatgcgggaaaatcgccgcccgcatgccggtatagtgcatcccggcaatggccagccccatcagaatggcagcgcccgcgcgcatttgcgcaacctgtgccgcttcatggcgcaaacggaaagtcagccacagggcagcccaggaggcgacaaacgcaatcaccagcgacaggacaacccagcgcatatcccagacgatcgccggtgaaacctgtaacgccgccataccggtatagtgcatggcggagatgcccgcgcccatcaccagcgaacccgggagtaaacgacgctgatgcaggttgggtttgcttaccagccacagcgcaaacagggaggcactaaaggcgatcagcattgacagggcggtcatgccgggggcgtagttcatgtgcatggtgagttccatcgacagcatgccgatgaagtgcatcgcccagatgccgatccccatggagaaactcccgccgataagccacacccatgcggttttgccctggctgctggtcacgcgtcctgccatattaagtgcggtatacgcggcgagaatggccacgacaaaagaaattacaaccaggacatggtcgtattggcttaccagcatgatgtcatcaactcgtttacgctaaggcgtcgtattttgtctacagaacaggcggaaagggcgagacattatcattgtctgcaaagggcgcaaagggatttaaatccatgatattaagaggggataacgacagtttcgcttaaaatcgccgacgatcaattactccagctcggaacagttcaccagctttaacggattaacggagttcatgttgcggcatttatccacttcagtggtgaccagctcaacccagaacattaacagcccgtcaaacaggaaaacggtgacggcaaatacaatcagccagccatatttacgcaacatattgtttgttcactctttcgccgatttggtgctggaaatatacacgaaatcccggctaatgaaagaatgacaagcagggttttttaccgctgtttcaggcaataaaaaaggcgcttccccatgccggtaagcgcctttttaaacaagcaatcaactgattagtatcagttcatgccgtattttttcaatttcttacgcagagtgccacggttgatgcccatcatcagagcagcgcgcgtttggttaccgcgggtgtattgcatcaccatgtccaacaatggctgttcaacttcagccaataccagctcatacagatcactcacatcctgaccattcagttgagcaaaatagttcttcagtgcctgttttaccgagtcacgcagaggtttttgagttacctggtcctgagagttaacggtagaaacggtcagtacgtcagaatttacgcgttgttcgaacatagttctgtcagctctttatttctgtttacgcaaaattttcgaagtatgcctccaacgcctccagctgttcgctggcgtcttcaatggcgttgaatgtgcgccgaaactggtcatctggagcgtgctcctggagataccaggatacgtgtttccgcgcaattcgataaccctttgcctgaccgtaaaagtcgtgcagttcccgaatatgcgcacaaagcaagcgcttcacctctgccagaggcaggggaggaagcagctccccagtgtccagatagtgctggatttcccgaaagatccagggtcttccctgagccgcgcgacctatcatcagagcatcagcccctgtatagtcgagcacagctctggctttaagcgggtcagtaatgtcgccattcgcgataatcggaatggaaactttctgcttaactgcccgaatactgctgtattccgcgtctccgttgaacaaacaggcgcgagtgcgtccatgaatggtcagagcctggataccacaatcttcagccagttgggcaatttctacgcagttacggtgttctggcgcccaacccgtgcgaatcttgagcgtaacaggaacgtccacagccgctaccaccgcagtcaggatagacttcaccagatctggatgctgcaaaagggctgaacctgccagcttgcgattcacctttttagccgggcaacccatattaatatcaataatctgggcaccgctttccacgttgatacgtgcggcttccgccatttcttcaggtacgctaccagcgatctgcactgtacgaatacccggctcatcaatgtgcaccatacgtaagcgtgatttatcactttcccagacctgagggttagatgacatcatctcggatacggtaagtcccgctcccatctcgtagcacaacgtcctgaatggcctgtcagtgatgccagccattggcgctgcgatcaggcgatttctgagctggtggtgtccgattcgcatgagttaagaaatgaccatactgtgactgcaaggcggcgtatattacgcattttttgcacgagatgaaaggccaaactttgaacaatccactgttgcagatcattgaatccgctattcatattggatttatcaataaattatcatgcgaatcattgagttatgttaatagtaataattcatgacgtaactaaaattccttaaatacagtgaattttgccgctaaaaaacggcgggttatctggtaacttgctgtttttatagacacttcaactccagtaatgcgatctacctctcgtttttttctgctcataaaagcatcgttacgcggtacgggttcacgcaatagtgtgtcgttattcgatgatcacccgaccgtgtcccggctgtacgggacgattattttcatgaggtaaaacgcgggtcagcgtcttcagttgttcctctgaaagcgaaagcggctctttcataaccagccagcgcacgccttccgtacagggcggcgtggtgagcgatccgctatagcgatagtacgttgtgcgtgcaggcagcagttttttgatgtcgacatcctgagtaagcgccacgctctcgtccgcctcgcgcggcatttcataccacagcttctggagttcattgtttggcttcccggtggtaaacatgacggccacgaccgccgtctcaccttgcgcgttctggtgcaccagatgcatctccagcgggtaatgcttaccaccaaccgtattttccgacggcgcatggaaatgcagttgccggagcaggaacagctcgccgtctattttcacgctgtttttgttaccgtcggcaaagttggccatcaccgtaaagccttcatggctgaggcttatcgggctttgcggataacgtggttttagcggcataagacgggttttcatgaccgctgtaatatcgacaggcgactggttcatccctttgctgcacataaaatagtccggattcagttctccccagtacgccggggcgctttctccttcataactccattcgtttgcggtggcgcaggtcgacagcagacccagcgctaataaagtcacgccgcgtaatccggtgctcataatattcatcctatgaatagttaatcccaaaaaagatattaattttcaatgaattgaaaggaaaattataagcttattggcggctgaataaacgacaaaaaatggggcaggcaggagaaaagcgcaacgcagcagaaaactgcgttgcggcagggacttattttttacgaccggtaatgcggcaccactcttctttttccacgacgggatcaagcgagaacagatcggcataggcatcacaaacgctttccgcctggctggccagaataccggaaaggcccagcagaccgccttcaacaggcagtacgctgatcagcggcgccagttcacgcagcgggccggcgaggatattcgccaccaccacatcggctttcatggtcgctggctggtcctgcggcaggtacagctccagacgatcggccacgccattacgttcggcgttatcacggctggcctgaatggcctgcggatcgatgtcgataccaatggctttcgccgcgcccagtttcagcgccgcaatggcgaggatgccggagccgcaaccaaaatcgatcaccgttttaccggtcagatccaggccatccagccattgcagacacagcgaggtcgtagggtgagtgccggtaccaaaagccaggcccggatccagcatcacattgacggcgttcacgtccgggacatcgcgccagctcgggcagatccacaggcgctcaccgaaacgcatcgggtggaagttttccatccactcgcgttcccagtctttatcttccagctgttcaattttgtgcgcaaaacccgcgcccagcagcggatgcaacgcaagcagtgataccacctcgttcatgtccgtttcggcatcaaacaggccgatgacgtccgtgtcaccccacaggcgggtttcgcccggcagcggctcaaacaccggcgtatcgtgcgtgtcctggaaggtgatagagacggcgccagcttcgagcagcgcatcgctcagcgcttcggcattcgccccggttgtattcagtttcagttggatccacggcatggcaaaactctttatttatcagatgtaataacgtgaccttccgcaaccgggcgaccaaacaggttcccgatcagaaacgccagcaaactcagtaacagcgacggaacaatcgggtggaagcccagatattgtattttaaacgtcgccagcacggcatagagcacaccgcccacaatcatcgcgctaagcgccccggccgcattggcccgctcccagtagaggcccagcaccagcggccacaggaatacggcttccagcccgccaaaggccagcaggttaagccagatgatcatctctggtggacgccaggccgccagcaacagcaagacgccaaggatcagcgtgatcgccgaggacattttcttcagccgcttttcattattgatctgcgccggatagagattcaggtagagatctttaatgatcgtagcggaactttgcagcaactgtgcgttgatcgtcgacatgatcgccgccattggtgccgcaaggaagatccccgccgcaaagggcggcaacactttcatcatcagcgttgggatcaccaggtccggcacgatcagatcggggatcaccgcccggcccagtgcgcccgccagatgcatgcccagcatcaggatcgccaccacaatggtgccgatgatcataccgcgatgcaccgctttgctgtctttataggaaatgcagcgcaccgccgtatgcggcaggccgatcaccccaaagcataccagcacccaaaacgaggtcataaaggtaggggtgagaatatcctcagcgccatgaggggacaccagtttcggatcgaggcgttgcagcgtatcgacggcgttacccagtccgccagcggcatgcaccacgccgaccagtagcacgatagtgccaatcagcatcaccatgccctggagggtatcgttgagcacgctggcgcggaaaccgccgtaggcggtatagagcgcaatgctgacgccaaaaatcagcagcccggtttcgtaaggaataccggccgccgtttccagcagacgcgcgccgccgataaactgcaccgccatcgcgcccacaaaggcgaccagcaggctgatactggccagccataccagcaggcggctctgatagcggccaaacagcatatcgttgagcgtcacggcgttataacgacgcgcgaggatcgcgaattttttgcccagaatacccagcgacagccagacggcaggcaactggatcatcgccagcagcacccagccgagaccatatttgtaagccgcccccggcccgccaataaatgaactggcgctaatgtaggtggcggtcagcgtcattgccagcacgatcccgcccatggagcggctgccgagaaaatactcgttaaggaatgagccggcggcgcgcttgcgcatggcatagaccgacaggccaaaaaccaccagcaaataggcgaccagtggcagaatgacttcaagctgcatcgtcgtcctccagggaaatatcccggtagataaatttcaccatcgcccagcacagcaggataaataccagcggcagcagcagacaggacatttcaaaccagtgtggcagtccggtgaacccggtcatatctcccggtaagtaagcggtcactaaccaggcggcgagataaagcagcgtaagccagagcgcccagcgggcctctttgtgcgcctgaacgaaacgtgtatccattatcgtccctcggggatcagaaaggcggggattgtaccgcaagagcgaaaaagagaataaaaaaaaggccggaaatccggccttttgctgcgagcgcttaattacttctcatgaagaccgagcttcttctccagatagtggatgttggtgccaccgtgctggaagttctcgtcattcatgatgcgggtttgcagatcaacgttggttttaatgccgtcgatgattagctcctgcaacgcatttttcatgcgggcaatggccacgtcgcgggtttcaccgaagcagatcagcttaccgatcatggagtcataatacggcggtacggtataaccggcgtaaatatgcgattcccagcgcacgccaaaaccgcctggcgcatggaaacgggtgattttgcccgggcttggcaggaaggtgttcggatcttcggcgttaatacggcactcgaccgcatgaccctgaaccctgacgtcttcctgtttgatggacagcggctgacctgcggcaatgcgcagctgctctttgatcagatccacaccggtgatcatctctgttaccggatgttcaacctgaatacgggtgttcatctcaatgaagtagaactcgccgttttcgaacaggaactcgaaagtacccgcgccacggtagccaatgtcaatacaggctttggagcagcgttcgccgatgaatttacgcagttccggggtaatgcccggcgctggcgcttcttcaacgactttctggtggcgacgctgcatggagcagtcacgctcggccagataaatggcgttaccctgaccatctgccagcacctgaatttcgatgtggcgagggttttccaggtatttttccatgtacaccatgtcgttgctgaatgccgctttcgcttcagctttggtcatggagatggattgcgccagttcggcatcaccgcgtaccacgcgcataccgcgaccgccgccgccgccggacgccttgatgatcaccgggtagccaatgcgtttagcatgggcacggttagcatccatatcgtcgccgagcgggccgtcagagcctggtacggtcggcacgcctgctttcttcatcgcggtgatcgccgacactttgtcgcccatcagacgaatagtgtcagctttcgggccgataaagataaagccagagcgctcaacctgctcagcaaagttggcattctctgaaaggaagccataacccgggtgaatcgctgccgcgccggtgatttcagccgcgctgatgatcgccggaatattcaggtagctttttacggacggtgccggaccgatacagaccgtttcgtccgccagtaatacgtgttttaaatcgcgatccgctgttgagtgcacggcgacagtcttgatgcccagttctttacaggcacgcagaatacgcagagcaatctcgccgcggttggcaatgacaattttatccagcatgttcgcctcgttattcgatgacgaccagaggctcgtcaaattctaccggttggccgctttctaccagaatggctttcaccacgccggatttgtcagcttcgatctggttcatcattttcatggcttcaacgatgcacagggtgtcgcccgcattcactttctggcccacttcgatgaacgcttttgcgtccgggcttggggtgcggtagaacgtcccgaccatcggggaacgtacgatgtggccactgatttctgctgctgccggcgcttccattgttggggtggcggcaggtgcaacagcgttagccagggctggctgttgcatcatcggtgcggcataagcctgctgcatcatgggataacccacgtttggcgcagcacggctgatacgaacagactcttcgccttcagaaatttccagttcggagatgcctgattcttcaaccagctcgatcagttttttaatcttacgaatatccatgagtgggttccgtactcttgtttagtgtgattgtgacaggcgttttaccgccgtctgtaaagcgtatgaataaccgtcagcgccaaatccgcagatgacgccagcagcgatatcggagagataggagtgatggcggaacggctcacgcgcatgcacgttgctcaggtggatctcgataaacgggatactcacggcgagcagggcatcacgcagggcaacgctggtgtgcgtaaacgcggccggattgatcaggatatagtcgacattgtctttagcctgatgaatgcggtcgatgagtgcatactccgcgttggactgtaaatgcgaaagagacacgttgagcgcttcggcttcctggcttaaagaagtaacaatttcgttaagcgtcagggtaccgtacttctccggctcgcgcgttcccagcatattcagattagggccgtttaagagcaaaatgtgcaacttgtccaccattgtgctgctatctcctgcaatacttcggtaaaaaacaaaatataccttcattgcccggttgtcaccttttcagagtcctaaaaaccctgtcggcaaaaccaaagtcgcacattataacgatttcgtagcatttggcagctaaatactggtcttatcagggaagattatcaaccgctatccaggaaatgacagcggatgacagaagaactgcgggaaagtgcacagaaccgtgcactattgccaccattgacggaacttcttgtaacgccacgccaaaagcaccagcgcggctaccgcatagagtaccggctgcggggataataccttcaccgaccacagataatgaatgggcgcgaggatcgccacaagataaacgaaattgtgcagacgttgccagtttctgcccaattttcgcatcatggcctgtgtggaggtcagcgccatcgccagcaggatcagccagctgataccgccgagcgtcagataaggacgggatatcagctcctggcccagcagaccaagattattaatccccagctccagcatgacgtaactcaccagatgcagactggcccaggtaaaacaccaaagccccagcaggcggcgggtgcggatcagcaacggttgtctggcgtaacgcgccagcggcgttaccagcagcgagccgagcagaaactttaacgccatcctgccggtaaaatgctgaatatctttcgccggatcggcgctgaaccagccctggctcgccgcccagaacagccagagcagcggcaacagtccggcaagatgcagtacacatttcagccccgtcacctgtttcgccgtcagacgcatttaaaaattctcccgcaaatccatgcccttatagagcgacgcgacttcatcggcatagccattaaacagcagcgtcggctgacgattcacgtccagcacgccgccggaaccaataaagcgttcagtggcctgcgaccagcgcggatgatcgacatgcgggttcacattggcaaaaaagccatattcattgggtgccgaaagattccaggtagtgggaggacgctcacgggtcagtttgatgctgacaatggatttaatgcctttaaagccatatttccatggcacggtcagacgtaccggcgcaccgttttgcggcggcagcgctttaccgtacacgccgacggttaacagggtcagcggatgcatggcttcatcaatacgcagcccttcaacatagggatatttcaggccgccgccgataaagcgatctttctggccgggcatctcgtccggggaatataaagtttcaaacgccacgtattttgcgttgctggtgggctccaccagcgcgagtagcttatgcagcgggaagccgatccacggcaccaccatcgaccaggcctccacgcagcgcatgcggtaaattcgctcctcaagggggaagcgcgtggtcagcgcatcgtgatcgagggtcagcggctttgccacttcgccgctgatggtgagcgtccagggatcggttttcatgctgccggcgttagccgccggatcggccttatcgagaccaaattcgtaaaaattgttgtaacccgtgactttttcttcaggcgtcagagaaagtttactctgccattcatcaggtttattaaagttcagcggtttcccggcgggggcttttggccggtcattgcccttaaaccagctgagcagatcggcctgcgccgcagaggaaagagaaagggcggtagcgctgatgcccagcgtttttaatacctgacgccgttgcagcataaataccgattctgccgtgacatctgcttctgttagttttcgtggtttcatctcatcctccgtctgctttatataagcatgacggatgagttgcgccagcgcgagtgtgttaccaaaatttgcctgctcacttttgtttgatagtatcccgtttcctgctgcaagttagcgcttactctacactatgtcatgacggcacaaagcgcccttcaaccaacggagttaactcagggatgcgattaacgacgaaattttcagcctttgtcactctgcttaccgggctggcaatatttgtcaccctgctaggttgttccttcagcttttactctgccattcagaacaaactcagcaaccgggtgcagtcggtggccgccattattgatagccgtctcgtctcaacgccggtaaatgttctcagcgcccaacttaatgaaatcatggtgccggtggatattgcgcgcatcgttatccggcagggcgatcatacgctggtcaatcagaccgccaaagatgtctatcgtccgcagggcagcaccacgcaataccgtgaaatcaccatccattcgctgaaaaatccaggtacgaccatttcaatgacttaccaggatccgatggtgaactattttcattccctgctggcgaccgcgcccttaaccctcgccatcggttttatggtgatcattatttttctggcggtgcgctggctacgccgccagctcgccggacaggagctgctggaaaaccgctcagtaaaaatcctcaacggggagcgcgggccgcaggtgcgcggaaacgtgcatgaatggccgtcgcgcaccagcagcgcgctggatgtgctgctgacggagatccagacggcggcggatcagcgcagccatatggataccctgatccgcgcgtacgttgcccaggacaccaaaaccgggctcagcaaccggttgttctttgataaccagctggcaacgctgctggacgatcaggaaaacgtcgggacgcacggcgtggtcatgctgatccgcctgccggattttgattcactgcgcgataaatggggcgcagccgccaccgaagacaacctgtttgtgctcattaatttgctttccacctttatgctgcgctatcccggcgcgctgctggcccgctatcagcgcaatgactttgccgtattactctcgcaccgcacgctgaaagagtcagaaagtatcgccgcccagttgctgaaatcggtggacgcgctgccgccgtcaaaaatgctcgaccgggatgacatgatccacattggcatttgcgcctggcgcggcgggcaatccaccgaacaggtgatggaacacgctgaagcggccacgcgtaacgccgtattgcagggcggcaacagctgggcggtgtgggatgatacgctgccggaaaaagggcgcggcaatgtccgctggcgaacgctgatcgaacagatgctcagccgcggcggcccgcgcttttaccagaaacccgcggtaacccgcgacgggcgcgtgcatcaccgggagctgatgtgccgcatttttgatggcgatcaggaggtcattccggcggaatatatgccgatggtgttgcagttcggactggcggaggagtatgaccgtcagcagatcacccggttgatccctttcctgcgtttctggccggaagagagcctggcgatgcccatcacggtggaggcgctgatccgcccccagttccagcgctggttgcgcgataccctgatgcaatgtgaaaaatcacaacgtaaacggattattattgaacttgcagaggcagatgtttgtcaacacatcagccgtttacaacctgtcgtgcgattaatgaccgcattaggcgcgcgaatagtggtcgctcaggcgggtttgacgctggtcagcaccagctggatcaaggcgctggatgtggaactgctgaagctccatccgagcctggtgcgtaacattgagaagcgcaccgaaaaccagttgttggtacagagtctggtggaggcctgcaaaggaacgcaaacgcgcgttttcgccaccggcatccgtactaaaggggaatggcagaccctgattgaacgcggagtggcaggcggacagggggatttttttgcagcctcgatgccgcttgacaccgaagtaaaaaaatattcacaaagatactctgtttgacctgccgtttaacgttatttcacgtagaataacgcgcgctgtatcttgtgggggtgtgcatgtctgcccgccagttcgtgcagtaaaaaagccagtgaatgaccttagactggttgcaaagtgatagcgaggaacgctgcggtctctatctgtcctgaaggagtcaggtcgatttgtaactcaaggacacaaactgcactaattttcaccgtagccgtcgatttttgcgccttgtcgctgctgcgtgtggttggtaaagtaagcggattttattcttccgccccagctttcaggattatccctcagtatgttgaaaaaatttcgtggcatgttttccaatgacttgtccattgacctgggtaccgcgaatacccttatttatgtaaaaggacaaggcatcgtattgaatgagccttctgttgtggctattcgtcaggatcgtgctggttccccgaaaagcgtcgctgcggtaggtcatgaagctaaacagatgcttggccgtacgccaggaaacattgcggctattcgcccgatgaaagacggcgttatcgctgacttcttcgtgacggaaaaaatgctgcagcactttatcaaacaggtgcacagcaacagctttatgcgtccaagcccgcgcgtgctggtgtgtgtgccggttggcgcaacccaggttgagcgtcgtgctatccgcgaatccgcgcaaggcgcaggcgcccgtgaagtctttctgattgaagagccgatggctgccgcaattggtgcaggcctgccggtttcagaagcgacgggttccatggtggtggatattggtggcggtaccacagaggtggccgttatctccctgaacggcgtggtctactcctcttctgtgcgtatcggcggcgaccgcttcgatgaagccatcattaattatgtgcgtcgtaactacggctcgctgattggtgaagcaacggccgagcgtatcaaacatgaaatcggttctgcttacccgggtgacgaagtgcgcgaaatcgaagtgcgcggtcgtaacctggcggaaggcgtgccgcgcggctttaccctgaactctaacgaaatcctcgaagcgctgcaggaaccgctgacgggtatcgtcagcgcggtcatggttgcgctggaacagtgtccgccggaactggcttctgacatctccgagcgcggtatggtattgaccggtggtggcgcgttgctgcgtaaccttgaccgcctgttaatggaagagacaggtattcctgtcgtagttgcagaagatccactgacctgcgtcgcgcgtggcggcggcaaggcgctggaaatgatcgacatgcacggcggcgatttgttcagcgaagaatagtcggtgtcagatccggggcggcgctattgccgcttcggttctggccggcctgagaatacgcatagcctatgaagccaatttttagccgtggcccgtcgctacagattcgccttattctggcggtgctggttgcgcttggtgtcattatcgccgacagccgcctgggtgcgttcagtcagatccgaacgtacatggataccgccgtcagtcctttctactttgtctctaacggtccccgtgccctgctcgacagcgtatcgcaaacgctggcatcacgtgaccagctcgaacttgaaaaccgggcgctgcgccaggaactgctgctgaaaaacagcgaactgctgatgctggggcagtacaaacaggagaacgcgcgtctgcgcgagctgctgggctcacccctgcgccaggatgaacaaaaaatggtgactcaggtcatctcgacggtgaacgacccttacagcgatcaggtggttatcgataaaggcagcgtgaacggcgtctacgaaggccagccggtgatcagcgataaaggcgtggtcggccaggtggtggcggtggcaaaacttaccagccgcgtgctgttgatctgcgatgccacccatgcgctgcctatccaggtcttacgtaacgatattcgcgtcatcgcggctggtaacggttgtaccgacgacctgcaactggaacacctgcccgccaacactgacattcgtgtcggcgacgtgctggtgacatccggtctgggcggacgtttcccggaaggttatccggtgggcgtcgtctcctccgttaagctggatacgcaacgtgcttacaccgtgatccaggcgcgtccgacggcgggtttacagcgtttacgctatttgctgctgctgtggggcgcggatcgtaacggggcaaacccgatgacgccggaagacgtgcaccgcgtcgcgaacgaacgtctgatgcagatgatgccccaggtattgcctgcccctgattcgatggggccgcctgcgcccgtgcctgcaccggcaaccgggttgccgcagtctgccggtacagcgccgggaggacaatagtgggcagttatcgtagccagggacgctgggtgatctggctctcgtttctcattgcgcttttattgcagattatgccctggccggatgacatcattgtctaccggcctaactgggtactgctaatcctgctctactggatcctcgctttaccgcaccgtgtgaatgtcggtacaggtttagccgtgggtgccatactggatctcatcagcggttcgacgcttggcgtgcgggccctgtcactgagcattatcgcttacctcgtggcgctcaaattccagcttttccgtaacctcgcgctctggcagcaggcgctggtggtgatgctgctttcgcttgccaccgaggttattgtgttctgggcggaattcctggtgatcaacgtctccttcaggccggaagtgttctggagcagcgcggttaacggtgttctctggccatggcttttcctgctgatgcgcaaaatacgccagcagtttgcggtgcaataaaagggtgttatgacagatctctatcttgcttccggctctccccgccgtcaggaattgctcacgcaactgggcgtctcatttgaacgtattctgcccggcaccgaagagtgccgtcaggcgcaggaaagcgcgcagcaatatgtgacgcgtctggcacgggaaaaagcccaggctggcgtggcgcaggcagcgcgggatttgccagtgctcggcgctgacaccattgtcattttaaatggcgaagtgctggaaaaaccgcaggatacctctcatgctgctaagatgttgcatcagctttcagggcaaacgcaccaggtgatgactgccgtagcgctggccgatcgtcagcacattcttgactgtctggtagtcacagatgtgacattcagagtactctctgatgatgagatcatggcgtacatcgccagcggcgaaccgatggataaagcgggcggctacgggatccagggactgggcggctgctttgtgcgacggattaacggcagttaccacgctgtggtcggcttaccgctggtagaaacctatgagttgctgagcaattttaacgcactgcgcgagggaaggaataaagatgacggctgaattgttggtaaacgtaacgccttcagaaacacgcgtggcgtacattgatggcggcattttgcaggaaatccacattgagcgtgaagcgcggcgcggaatagtcggcaatatctacaaaggtcgtgtgagccgtgtgctgcccggtatgcaggcggcttttgtagatattggtctcgataaggcggcgtttctacacgcctccgatatcatgccgcataccgaatgcgtggccggggaagagcagaaaaacttcaccgtgcgcgacatttcagagctggtgcgtcaggggcaggatctgatggtgcaggtggtgaaagatcccctcggcaccaaaggcgcgcgtctgacaaccgacatcaccctgccatcccgttacctggtgtttatgccgggcgcgtcccacgttggggtatcccagcgtattgaaagcgaaaccgagcgcgagcgtttaaagcgcgtagtggcggaatattgcgatgagcagggcggttttatcatccgtaccgccgcagaaggcgtatgcgaagaagacctggcctccgatgccgcctaccttaaacgcgtatggacgaaagtcatggagcgcaaaaagcgcccgcagacgcgttaccagatgtatggcgaactggcgctggcccagcgcgtgctgcgcgatttcgccgacgcgcacctcgatcgtatccgcgtcgactcccgcctgaccttcgaagcgttgctggaattcaccgccgaatatattccggagatgaccagcaagcttgagcattacagcggacgccagccgattttcgatctctttgacgtcgaaaacgaaattcagcgcgcgctggagcgcaaggttgaactgaagtccggcggctatctgatcatcgatcaaacggaagcgatgaccaccgtcgatatcaataccggggcctttgtcggccaccgtaatcttgacgacaccatttttaacaccaacaccgaagccacccaggctatcgcccgtcagctgcggctgcgcaacctcggcggcattattattatcgatttcatcgacatgaataatgaagatcaccgccgtcgcgtgctgcattcgctggagcaggcgctcagcaaggatcgcgtaaaaaccagcatcaacggtttctcacagctcggcctggtcgagatgacccgcaaacgcacccgcgaaagcgtcgagcatgtgctgtgcaacgaatgcccgacctgccatggtcgcgggacggtgaaaaccgtcgaaaccgtctgctatgaaatcatgcgcgaaattgtccgtgtgcatcatgcctacgattccgatcgtttcctggtctatgcttctccggcggtggccgaggcgctgaaaagcgaagagtcccacgcactggcggaagtcgaaatttttgtcggcaaacaggtcaaagtgcagattgaaccgctctacaatcaagagcagttcgacgtagtgatgatgtaattcgtagcatgctgcgacacgatcaaggcctgttgcgcgggctgacaaggagagatgcgtgaggcgactgccggggatattgctgctgactgtggcgacattggttgtcatcattgcgctgctggtgagcggcctgcgcctgatgctgccgcatctggacagctggcgtccggccatcctcgcgaaaatcgaatcctcctccggcgtgccggtagacgcaaaacaggttaccgccagctggcaaaacttcggcccgacgctggacgtacgcggcatccacgccggttttaaagacggcggcgaggtgtccattgagcgcgtcaccctggcgctcgacgtctggcaaagcctgctgcacctgcgctggcagttccgcgatctcaccttttatcagcttcaggttcataccaatacgcccctgcaacagagcaatgacagcgagggcatggaaaccagccgtctgagcgatctgttcctccgccagttcgaccatttcgatctgcgcgacagccatatcagtttcctgacgccatccggacagcgggccgagctggcggtgccacagctgacgtggcttaacggcaaagcccgtcaccgtgccgaaggcgaagtcagcctctccagccttaccggacaacacggcgtgatgaaagtgcgtatggatctgcgtgacgacgaagggctgctcaaccatggccgcgtatggctacaggccgatgatattgacgtcaaaccctggcttggcaaatggatgcaggataacgtcgccctgcaaaccgcgcgctttagccttgagggctggctgacgctgagcaaaggcgaagtgtcggggggcgatgtctggctgaaaaaaggcggcgccagctggaaaggcgatagccagccgcaccgtttgtcagttgataatctgacggcgcacgtcacccgccagcagcagggctggcagttcgatattcccgaaacccgtatcaccatggatgacaagccgtggccgaaaggcgcgctgtcgctggcctgggttccggcgcaggaagtgggcggggcgaagggcgtacgcagcgacgaactgcgcgtgcgcgccagccatctggaactgaacgggctggacggcctgctgcccattgccgaaaaactctcgcctgcgctgggcgaaatctggcgcgccatgcagccgaccgggcaaatcgaaaagctggcgctggatattccccttcaggcgactgaaaaaacccgctttcaggcgaactggaacaatcttgcctggcagcaatggaaaatgctgccgggcgtcgagcactttaccggtacgctctccggcagcgtggacgacggcaggctgaccggcagcgtcaccgatgcgaaaatgccctacaaaacggtattccgcgcgccgctggaaatcgaaaagggcgtcgccacacttaactggctgaaaaatgacaaaggtttccagctcgatggtcggcagattgatgtcaaaggcacgggcgttcatgcgcgcggcgattttcgttatctgcaacctgccggagatgaaccctggcttggcattctcgccgggatcagcaccgatgatgccggacaggcctggcggtacttcccggaaaacctgatgggtaaagcgctggtggattacctgagcggcgcaatccagggcggccaggtggataacgccaccctggtgtacggcggtaatccgcatctgttcccctataaacataacgaaggccagttcgaagtgctggtgccgctgcgtaacgccaccttcgcgttccagcctggctggccggcgcttaaaaatctcgatatggaactggacttccttaatgacggcctgtggatgaggaccgatgaggtcaaccttggcggtgtgaaaggtcataatctgacggcggtgatcccggattacctgaaagaaaaactgctgatcgatgctgatatcagcgggccaggcaaagcagtggggccctatttcaacgacacgccgctgaaagattcgctgggcgccacgctggaagagcttcagcttgatggcgatgtaagcgctcgcttacacctcgatattccgctggatggcgaaatgacgaccgccaaaggcgacgtgcgcctgaataataacagcctgtttattaagccgctgaacagcacgctgcataatttaagcggccagttcagctttgagaacggcaatctgaaaagcgagccgctgaccgcccgctggtttaatcagccgcttaacgtgaatttctccaccaccgagggcgaaaaggcctatcaggtggcggtagatctgaacggtaactggcagcctgcgggcatagaggcgctgccgaaacagctgcgcgatgccgtcagcggtagcgccgcctggaatggcaaagtgggcatcgagctgccttatcatgccggtgcgcgctacaacgtggatatcaaaggcgacttaaaaaatatcgccagccgtctgccttcgccgctggaaaaagccgccggtcagccgttgccgttaacggtgaaagtggaaggcgacctgcggcgtttcgatctgacgggcaaagcgggcagcgacagccatttcaacagccgctggctgctgggtaaaaagctgaccctggaccgcgctatctggacgtcggaaagccggacgctgccgccgctgccggaaaccgcaggcgtggagctgaatctgccgccgctggatggcgcgcagtggatggcgttgctccagcagggcgtggcgaataacgtcagtagcgcgacggccttcccggaaagcattaccctgcgtaccccggcgctgacgctcggcgggcagcaatggaacaacctgagcatcgtgaagcagccggtagcgggcggtgctaaagtcgaagcccagggacgtgaaatcaatgctactgtcacgatgctggataacgctccctggcaggcggcgatccgctatctctattacaacccggcggcggccgagcgcgatccgctgtcgccgacgacgctgcttaccaaacggcagatcgatttcagcggctggcctgatctgcaattacgctgcgcggagtgctggttctggggacaaaaatacgggcggctcgacggcgatttcacgatcaatggcgacaccttaaccctgaagaatggtctgctggacagcggctttgcccgtctgacggcgaacggcgaatgggtcaaccgcgccggtgccgaacgcacgtcgattaagggcagactgaagggggataagatcgacgcggcgaccaatttctttggtgttaccacgccactgcgggaagcgccttttgacgtcgattacgatttgcactggcgtaatacgccctggcagccggaagaggcctccctcaatggtattctgcgcacccggctgggtaacggcgagatcgcggatgtcagcaccggacgcgccgggcagctgctgcgcctggtaagtttcgacgcgctgctgcgcaagctgcggtttgatttcagcgacaccttcagcgaaggattctactttgactccatccgcagcaccgcctggatcaaagatggcgtgctgcataccgatgacaccctggtggatggcctggaagcggatatcgccatgaaaggatcggtagacctggttcgccgtaaactcgacgtggaagccgtggtggcgccggaaatctccgctaccgtcggcgtggcggccgcttttgcggttaaccccatcgtcggcgcagcggtattcgccgccagtaaagtgctggggcccttgtggaataaagtctccatcctgcgctaccagatcaccggcaccatggataaaccacaaattaatgaagtgctgcgccagccgcgtagcccggcgaagcaatgatttgacgggggcgagtaattgcctcactctcaatagatatgatttctaccgctaacctggcggcaaccaaagagtagcaacatgacgagtttgaatctggttagtgaacaattgctaacggcgaatggcctgaatcatcaggatctgttttccattcttggccagctggccgagcgccgtcttgattacggcgatctctatttccagtcgagctatcacgagtcctgggttttagaagacaacatcattaaagacggctcgtatcacatcgaccagggcgtcggcgtgcgggcggtaagcggtgaaaaaacgggctttgcttacgccgatcagatcagcctgctggcgctggaacagagcgcgcaggcggcacgcactatcgtgcgcgacagcggcgacggtaaagtgaaaaccctgggcgcggtggagtatggcgcgctctataccagcgtcgatccgctgcaaagcatgacccgcgaagagaagctagacattctgcgccgcgtgaatgcggtggcccgtgccgcagataagcgcgtacaggaagtgaatgccagcctcaccggtgtttatgaactgatcctggtggccgcgactgacggcacgctggcggcggatgtccgtccgctggttcgtctgtcggtcagcgtgcaggtggaagatcagggcaagcgcgagcgtggctcaagcggcggcggcggtcgtttcggctatgaatggttcctcgccgatgcgggcggtgaagtccgtgcggatgcgtgggcgaaagaagctgtgcgtatggcgctggttaatctctccgccgtggcggcccctgccggtacgctgccggtggtgctgggcgcgggctggccgggcgtgctgctgcacgaagcggtcggtcacggtctggaaggggacttcaaccgtcgcggcacctccgtgttcagcggacagatgggccagctggtggcctccgaactctgtaccatcgttgatgacggcacgatgcacgatcgtcgcggctcggtagcaattgatgatgaaggtacgccaggccagtacaacgtgctgatcgagaaaggcgtgctgaaaggctatatgcaggacaagctgaacgcccgtctgatgggcgtcgcgccaaccggtaacggccgccgcgaatcctatgcccatttaccgatgccgcgcatgaccaatacctacatgctggcggggcaatccacgccgcaggagattattgaatccgtcgaatacggcatctacgcgccaaactttggcggcggtcaggtggatatcacctccggtaaattcgttttctcaacgtccgaagcttatctgattgaaaacggtaaagtgacgacgccggtgaaaggcgccacgctgatcggctccggtatcgaagccatgcagcaggtgtcgatggtcggtaacgatctgcaactcgacagcggcgtgggcgtatgcggtaaagaagggcagagcctgccggtcggtgtgggtcagccgacgctgaaagtggataacctgaccgtaggcggtacggcgtaatttattgcgtgaaattgcccggcggcgctgcgcttgccgggcctacatcatttctctttcgcccgtccgcgcatcgcctgaaacaggttcgccacctcaacaaaataatccgtcagatagttaatacacacctgcaccttgagcggcagcttgtccttttcggtataaagggcgtaaaccgggcgtggatctgactggtagcgcggaaataagatctccagcgtgccgcggttgatctcatcgatcacccacatcagcggcacataggccactccggccccggcggtcagccagcgggttagcgtcatcggatcgttagtgacaaaacggccctgcgggatcaggcgcgtggatagcccttcaggggcgatcagctcgaattcgttatccgggcgcacgctgtactccagccaggagtgattgctcagatcggcgggtttttcaggaatgccgtactgcgccagatagcttttcgcggcgcacaccaccatcggcatcgcccccagacggcgggaaaaaaggctcgaatcctgcaatgcccccacgcggatcaccacgtccagcccgtcggcaataagatcgggggcggggatccccgtcaccagattcaccgtcaggccggggtaatccttcagcatccgggcagtcatcccggcgaggacattttgcgccatggttgaagaacagccgatgcgcagcgtaccgatgggcgtgttattaaaagcgtagagctgttcatgcacgtcctgtacttcatgcagcatccgtcggcagccctgataataaattttaccggcttcggtcagcgccaggctgcgggtgctgcggttaagcaacttcacttgcaactcatcttccagcttcgagacggtctggctgatagaggagacgctcatatgcagctgtcgcgcggcagcggtgaacgaacccagttcgacgacgcgggcaaacaccgacatgcgttttaatcgttccattgttcactctggcttaaaagtgatttagatcacactatatagatgacagcataacagttacgctaatatatagttagctgaataatagatacgtcactctcgcctggcctttctggccctaatccctgcggtgacgtgaataataattgtctcctgcatgcgttaatcaaggtcaacatgagtctgtttcccgtggtcgtggtgttcggtctgtcgttcccaccgatattctttgagttacttatatcactggcgctgttctggctggtgcgccgtctgctgctcccgacaggtatctatgactttgtctggcacccggcattgtttaatacagcgctatattgctgcttattttatttactgacgcgcctgttcgactgaggtagatgtgaaaacactaacaagaaattttacccgtaccgccatcaccgtggtgatggttattctggcattcatcgccatctttcgcgcatgggtctattacaccgaatcgccatggacgcgtgacgcgcgttttagtgccgatgtggtcgccatcgcgccggatgtcgcggggctgatcaccgatgtgaaggttcacgataaccagctggtgcagaaagaccaggtgctgttcaccatcgaccggccgcgctatcaaaaagccgtcgaagaagccgaggctgacgtggcgtactaccgcgcgctggcaagtgaaaaacgccgcgaagccggacgtcgtaataaattaggcatccaggcgatgtcccgcgaggagatcgagcagtccaacaacgtcttgcagacggtgatccaccagcaggcgaaagcgcaggcgacgctggatctggcaaaactcgatctcgaacgtaccgttatccgcgccccggccgcaggctgggtgaccaacctgaacgtctataccggggaatttataacccgcggttcgacggcggtggcgctggtcaaacaaaattcattttatgtactcgcctatatggaagagaccaagctggaaggtgtgcgaaccggctatcgcgccgaaattacgccgctgggcagtaaccgggtgcttaaaggcacggtagacagcgtcgccgccggggtcaccaacgccagcagcagccgtgacgccaaaggcatggcgaccattgactccaatcttgaatgggtccgcctggcgcaacgcgtgccggtgcgtattcgcctggacaatcagaaagagaatgtctggcccgccgggaccacggccacggtggtgatcaccggtgaaaaagaccgggacgaaagccaggactccttcttccgtaaactggctcatcgtctgcgtgagtttggttaagcatgatgggcattttttccatcgccacacagcacattcgcttcgccctgaaactggcgtgcgccattgtgctggcgctgttcgtcggctttcacttccagcttgaaaccccacgctgggcagtgctgacggcggcgatcgttgccgcaggcccggcgtttgcggcggggggagaaccttactccggggcgatccgttaccgcggcatgctgcgtattatcggcacctttatcggctgcgtggcggcgctgaccatcattattctgatgatccgcgcgccgctgctgatgctggtggtttgctgtatctgggccggattttgtacctgggtctcctcgctggtgcgtgtcgaaaactcctacgcctggggactggcgggttatacggcgctgatcatcgtcatcaccattcagtacgagccattactcacgccgcagtttgcggtggagcgatgcagtgagatcgtactggggatcgtttgtgccatcgtcgccgatttgctgttttcaccccgctccatcaaacaggagatcgaccgcgaactcgacagcctgctggtggcgcaataccagctgatgcagttatgcatcgcgcatggcagcggcgaagagatggataaagcctggggcgcgctggtgcgccgtaccacggcgctggaagggatgcgcagcaacctgaatatggaatcctcccgctgggcgcgggcgaaccggcggctgaaagtgattaacaccctgtcgctgacgctgatcactcaggcctgtgaaacctggcttattcagaacacccgaccggaagcggtgaccgacaccttccgcgaactctttgcggagccggtagaaaccgcgcaggacgtacataaacagctcaagcgcatacgccgggtgattatctggaccggcgaacgcgacacgccggtgacgatttacagctgggtcggggcggcaacgcgctatctgctgctcaggcgcggggtgatcggcaacaccaaaatcagcgccacggaagaagaggtgctggaaggcgaaactgtggttaaagccgggtccgccgagcgccatcatgcgatggtgaacttctggcgcaccacgctctcctgtattctcggcacgctgttctggctgtggacgggctggacctcgggtaacggcgcgatggtgatgatcgcggtggtgacctcgctggcgatgcgcctgcctaacccgcgcatggtggcgattgattttgtgtacggtacgctggcggccttacccctgggggcgttctacttcttggtggtgatcccctccacgcagcaaagcatgctgttgctgtgcatcagccttgcggtgctggccttctttatcggcattgaagtgcagaaacggcggctgggatcccttggcgcgctggcgagcaccatcaatattattgtgctggataacccgatgacctttgaattcagccgctttcttgacagcgcgctggggcagattgtcggctgtatcctggcgttcacggtgattgtgctggtgcgggataactcccgcgcacgtaccggacggatgctgctcaatcagtttatgtccgcggcggtatcgtccctgaccaccaataccgcccgacgtaaagaaaaccatctgccggcgctatatcagcagttgtttttactgctgagcaaatttccggatgatgtcgccaaattccgtctggcgctgacgctgatcatcgcccaccagcgcctgcgtgacgctccggtaccggtgaacgccgagctgtcggcctggcatcgccagttacgacgcacggcggatcaggtgatgtcggccaccagcgaccacaaacggcggcgctactttacgcagctgctgggtgagcttgatgtgtatcaggagaagctgcacagctgctccgcgccggatcaggtcactcatcctgtgaagcggctggtggatatgctccacaaatatcagcatgcgctgactgacagttaagcccacaaaccgacgccagaagcgtcggtttttttatggctatacttaacttcattgcccgaaaaccgaggctcaggaggatatatgacaacgcaggcacttcaggatcatgcgctattccagacaggttattttgttgatggagtatggaaaaaactggaaacgacctttgaggtcaccaacccggcaacgggcgaggtcatagcgaaagtcgcgaaagccggtaagaaagagacggaagaggccattgccgccgccagccgtgcctttcccgcctggcgcgcgaaaaccgctaaagaacgctctgcgatcctctatcgctggtatgaactgattatcgagaataaaagctggctgggacagctgatgaccgccgaacagggcaaaccactgaaagaagcggaaggcgaagtggactatgccgccagctttattcaatggtttgctgagcaggccaagcgcgccaacggcgaaatcatcccgcctgccaaagcgggctcacgcatctttgccacccgcgaaccggtgggcgtagtggcggcgatcacgccatggaacttcccgatggcgatgctgacccgtaagctcggcccggcgctggcggcaggctgcactgctttgatcaaacctgcaaataatacgccgctcagcgcctttgccctgatccagctggcgaaaaaagccggggtgccggatggcgtactgaacgccgtggcaggcaccacggcggaaatcagcgacgccattatggccagtccggaggtgcgcaaaatctcctttaccggatcgacggcggttggcaaaacgctgatgcgcaacgcggcggacaccatgaaaaaggtgtcgatggagctgggcggcaacgcgccctatatcgtcttcgaagatgctgatattgacgcggcagtgcagggggcgattgccaataaattccgtaacgccgggcaggtgtgcgtcagcgttaaccgtttttatatccatgagtcagtgtatgacacctttgtcagcaagctggcgagcgccgtcagcgctctgaaagtgggtaatggcgtggaagagggcgtggtggtcggcccgctgattgaaccttccgcagtagataaggtacgcgaacacgtcgaggatgccgtggcgaaaggcgcgaaagtgctggcaggcggtaaagcgcatgcgctgggcggcaatttctgggagccgacggtactgggcgactgtagcgatggcatgaagctggccgccgaggaaacgttcgggccgctggccgcctgcttccgctttacctcggaagaagaggtgatccgccgcgccaacgatacgccgttcggccttgcggcctatttctatacgcaaaatctggcgcgggtattccgtgtctcgcaggccattgaaagcggcatgattggcgtcaacgagtgtgcggtttcgaccgagctggcccccttcggcggcgtaaaagagtcagggctgggtcgcgaaggctcggtgctggggctggaagaatttatggaagtgaaaaccctgcatctggggggattataaacatcagcggcggctctcgccgcccgtgcgcgcgggatggctggcaatgaatactatctacacttttgattttgatgagattgaggaccagacggatttttaccgtgaatttgcgcgcgcctttaatattgagcgggcaaaggtgcacgatctggattctctctgggatgtggtgacagggggcgctttacccgtaccgctggagatcgagtttctgcatctggcggataaagagcgtcggcgctatggcgcgctgatcctgctatttgatgaagcagaagaagaactggaaggggcgctgcgcttcaacgtgcgggcctgaaacaaaaaagcccctgcagggcaggggcaatcatatagcactacggagggaattatttatagagttcagcagtggcgtgccagctgtcaccggtacgtgcttcgataatgcggtaagaagacgcaccttcttgctgagcttttttatccagtgcggcacgcatatccatcggagaggagttaacgccaccgacggaaacggtaccgattgactggcgggcctgtgcctgatcgctgccgataacgttcgcggcagatgcgccgaaggacaggacggaaaggatgctcagggcggctacagtggttttgattttcatgttgtttacctcgtcgaattcttttactgaaggcctttctttgtgaccttcatcacagaatcaagtatacactaatcacgcgaataattaataccatgctaatggtttcagtgtggttttggttacaaaattaactctttttattcctgaaaagcattaaaaatggcgaatttttgtcacgcgcggaaaggatcaatataaaaatcagagtgatagatgattttgattttttgtgcggttttattcactgggtgaatgtaatgggacagaaaatcgcactttctgttaaagaaatgtgggtgataaatagcggaaaaggggaaaaccgcagtggtatcccccaatagctacccgttgatgaggtggtttttacagctcctgctcaaatagcacaaggatcgcttcatacagctctttgacagtaaagccgctggccggcgtggtgaaaatcgtatcatcaccggcgatggtgccgagaataccttccgacttgcctaaggagtccagcagacgggcaatcagctgcgccgcgcccggactggtgtgaataaccactactgccgcgttgtaatcaatatccagcaccaggttcttcagcgggctggaagtcgtcggaacgcccagctcggcaggcaggcagtacaccatctccatcttcgcgttgcgggtgcgtaccgcaccaaatttggtcagcatgcgcgagactttagactggttgatgttatcgaaaccctgctcctgcaatgcgagcacgatttcaccctgggagctgaatttttcttctttaagcagcgctttaaacgctttaattaattcttcttgtttggccgaacttcgcataagtcacccgtggaatggcgagagaaacaccattattatgcatataaatgaatttttatgcaaattctcagcctgattaaaggctgaaataatgtaatgaaagggcgggattttatcaaaaaacgttatcgataaacatgcctgcgtcacgtgtctctgatttggttaaaagtaaattaaatgttatcaaattgatgttgttttgagggctttagtgggtgtattgtaccgccacggctcggttgctgacgctataaagccatgcagtttcccccaaagggcaacaggaagtgaatgatgctaaaagcgtgcgaggccgcattcttttgtcatggatattgttaacatttaccgaagttttaaaggtcgccagcaacggtttcaacatatttaccttaccataataaggagtttaggatgaaagttgcagtcctcggcgcggcaggtggtatcggccaggcgcttgcccttcttctcaagacccaactgccttcaggctcggaactctctctgtacgacatcgcgccggttacgccaggcgtggcagttgatttgagtcatatccctaccgctgtaaaaattaaaggtttctccggcgaagacgccacccctgcgctggaaggcgcggacgtggtgctgatctccgcaggcgttgcccgtaagccagggatggatcgctccgatctgttcaacgttaacgccggtatcgtgaagaatctggtcagccaggtggcgaaaacctgtccgggcgcctgtgtgggtatcatcaccaacccggtaaacaccaccgtcgctatcgcggcagaagtgctgaaaaaagccggtgtttacgacaagaacaaactgtttggcgtcaccacgctggacatcatccgttccaacacctttgttgctgagctgaaaggcaagcaaccgggtgaggtggaagtgccggttatcggcggacactctggcgtgaccattctgccgctgctgtcgcagatcccgggcgtgagctttaccgatcaggaagtggccgatctgaccaaacgtatccagaacgcgggtactgaagtggtggaagcgaaggccggtggcggttccgctacgctgtcgatgggtcaggccgctgcgcgctttggtttatcgctggtgcgtgcgctgtcaggtgaaaaaggcgtggtggaatgcgcatatgttgaaggcgatggcgaacacgcccgcttcttctcgcagccgctgctgctgggcaaaaatggcgtggaagagcgtcagtccatcggcacactgagcgcctttgaacaaagcgcgatggaaggcatgctggaaacgctgaaaaaagacattcagctgggcgaagagttcgttaaccagtaacggtctgggcagtctctgcatgctaaaaagccggaatattgttccggcttttttacgtctgctatgtagtggcggggtattcctggatagtgaccttaagggacagcttcttatcttcgcgcatcacctcaaccggaatttctgaacccgggcggatctccgccacctgatccatagtttccagcgccgataccgccggtttattgttcaccgagataatcacgtcgttcacctggatccctgcgcgcgccgccggaccgtccggcgccacttcgttcaccacaatcccctggatctgatcgatgccgccaccctgggtatgcagcggggcgatctctctgccgctgatgccgatgtagccgcggatcacccgaccgtcgcggatcagcttatccataattttggtcgccagctggaaggggatagcaaagccgataccttccggcgtttcgccgtcgttgctcttgtcaaaggagagggtgttgatgcccattaattcacccagcgagttaaccagcgcgccgccggagttgccgtggttaatggaggcgtcagtttgcaggaagttctgccgtcctgacgggttcaggccaatacgaccggtggcgctgacgatcccctgagtaatggtctgcccgaggttgtacgggttgccgatcgccatcaccacatcgccgatatgcggcatgcgtttacggttgatggggatcaccggcaggccgccggtggcgttgactttcagcaccgccagatcggttaaggcatcggatccaaccagcagggcttcaaacacccggccatcctgtaaggcgacgataatctggtcggcgtcattgatcacatgcttgttggtaatgatgtagccgcgctcgtccatgatcacccctgaccccagggtgcggatctccagctggttattggcggaggcattcacgctgcggttatagacgttaaccacggcaggcgcggcgcgacgtaccgcctggttgtagctcaccggcgtgtcgtcagcgctgtcaaatttgggcgtcgacaacggactaaactgacgtagagagggcatagcagccagaagaaggccaccaacaatcaaaccgattgcaacggagcgtatgagctttacaaacatgatgcaggcgtcaccagagagagaatgggcagcatagcatgagttatccggacatcacacgtggggatgatgtccggaaccacaaataactaacgtaataataaataaagcgtatcgttaccgcgtaccacgtgcagggcgatgatattcggtttcgcttccagcaccttgcgcatttccgctatcgtctgcacgcggtcccggttgacgccaataatcacatcatctttatgcaggccggcctgggcggcaggactgctcttttccacttcagagatggtgatccctttggtaccgtctttcagctggccgtcgtttaaggtcgcgccctgcaacgccggggcgatcatttccgcgctcgctgaagatgaggtgcttttatccagcgtaacttccacgtcctgcggtttaccgtcgcgcaacaggcccagcttcactttcgagcccggctcggtggtggcgatgcgggagcgcagctccgcaaagctgttcagcggttttccgttgaggctgacaatcacatcgccggatttgatccccgctttggccgagccggaattgggcagcacttcgctgacgaacgcgcctcgctgcacgttgaggttaaaggctttggcaatatccgcgctcatttccatgcctttaatgcccagcagtccgcgcttgatttcaccgaactggatcagctgtttggccagcgtttgcgccatgttgctgggaatggcgaaaccgatcccgacgctaccgccgctgggggcaagaatggcggtgttaatgccgatcagctcgccgttcaggtttaacagcgcgccgccggagttgccgcggttgatggaggcgtcggtctgaatgaagttttccagcccttcaagattcagcccgctacgcccgagcgctgaaacaatgcctgaagtggcggtctggccgaggccaaaagggttacccacggcgacggcgaaatcgcccacccgcaggctgtcggaatcagcgacggcgatttgcgtcagattggtggcattttgcagttgcagcagggcaatgtcgctctggtcatcgccgccaatcagtttggcttcaaattcacggccatcattcagctgcacattaattttctgcgcctggttgatgacatgattattggtcagcacataacctttggcggcatcgataatcaccccggagccgaggccttcaaacggctgggcttgctgatccggcgcgtcctcaccaaagaatttcttcagttcttccggcactttgggattttgctgcaccgcggtgccttccacctgcacgctgactaccgcaggcaacactttttccagcatcggcgcgaggcttgggatcgcggcctgacccggaacctgtgacggcaaggccgccatcgtctgtaacggcgcggcaagcgctaatccaacacctaacgctaacgcactcaatagctggttttttttcttcattgatgctggctctcgtaacctgaagtgtaaggaaaaacgccccaaaacagagggatgttattgaaattttgcacgggtaacaatgaggacaatgactaaataatagctgtgatgggaaagaagaggcgggcgcaacctgcgcgcccgtaaaaattctggcttaacagtcgtttaatcgcgtttcttcgcgccgcgcagcaggcctgacgcaccttctgagtagtcgcgcggcatctgtaccggagcctgatcgttacccgcttccgattcagcaaggcgattgcggaacggattcatctcggcggacatttccggcagcaactggctggagcttttcgccatgtgctggtacagctggcgataatcatgggccatgttatcgagcagctcggcgctgtgggcgaaatgtccgactaactcctcacggtactcttccagctcggccttatttttttccagctcgtattgcagggcctgctggttgcgtaacttgcgattaccgaaacgcatggctacagcaccaattacgatgccgacgactaaaccaattagcgcatattcccaggtcatgaacatctcccgttgtcttgtgattccgtagggtgttggcagggaggctcctcgcctgtgcctgattatgccactataaccgctaattccgtataagtggaatcctgaggctgcatcgcgtagtgtggaacggcctttttttcgtcaaccgtgaattacggcataccgatactcaaggaataacaataacatcatgcaaagtattacccccacatcgcgataccagcaagccctggatgcgggtacgcatcagccagacgaggtgcagcgcgcggcggttaaccggctggacgctatctggcagcaactcacgcaaacccacactacgcctgcgccacgcggcggcctgatggcggccttcggcaaactgctcggtaagaaagaagaatcgacaacccctcccgtacgcggcttatatatgtggggcggcgtcgggcgcggcaaaacctggctgatggatctgttttttcagactttgcctggcacacgtaaacagcgtctgcactttcaccgctttatgctgcgcgttcatgaagagctgacggcgttacagggagagagcgatccgctggaaatcatcgccgatcgctttaaagccgaaaccgacgtgctctgctttgacgagttttttgtgtcggacataaccgacgccatgctgcttggcggcctgatgaaagcgctgttctcgcgcggcatcacgctggtggcgacctctaacattccaccggatgagctttaccgcaacggcctgcaacgcgcgcgcttcctgccggcgattgaggctatcaaggcaaactgtgacgtgatgaacgtggacgcgggcgtcgattaccgtctgcgcaccctgacgcaggcgcatctgtggctgtcacccttaaatgacgagacggcgcagcagatggaaacgctgtggctggcgctggcaggcgcgccgcgcgagcagcggccagcgcttgagatcaatcatcgcccgctgcaaaccctgggggcggaaaatcagacgctggcagtttccttcactacgctgtgcgtcgaggcgcgcagtcagcacgactatattgcgctatcgcgtctgtatcacacggtgatgctctacgacgtgccggtgatgacgccgctgatggagaacgaagcgcggcgctttatcgcgctggtggatgaattctacgagcggcacgtgaagctggtggtcagcgcgcaagccccgttgcatgagatttatcagggtgagcgggtaaaatttgaattccagcgctgcttgtcccgcttacaggagatgcaaagcgaggagtatctgaagcgcgagcatctggcataatcgcctccccaggcacggcgcggggaaaagtatcgtcgcaatcacaaaaaggggtcgatctttgtacccgacttccctataatcttgcgaccccacgttacgagaaagtttttttcccaaaacttttgtgtgccggcataggctattcgaaggggtaggtttgctggacaatgtcgtgtgaacctcaactgactaaacgtttgggtgttcaccaacgtgtaactatttattgggtaagcttttaatgaaaacttttacagctaaaccagaaaccgtaaaacgcgactggtatgttgttgacgcgaccggtaaaactctgggccgtctggctaccgaactggctcgtcgcctgcgcggtaagcataaagcggaatacactccgcacgtagatactggtgattacattatcgttctgaacgcagaaaaagttgccgtaaccggtaacaagcgtactgacaaaatgtactaccatcacaccggccacatcggtggtatcaaagaagcgacctttgaagagatgattgcccgccgtcctgagcgtgtgattgaaatcgcggttaaaggcatgctgccaaaaggcccgctgggtcgtgctatgtaccgtaaactgaaagtttacgcgggtaacgagcacaaccacgcggcacagcaaccgcaagttctggacatctaatcgggattatggcaatggctgaaaatcaatactacggcactggtcgccgcaaaagttccgcagctcgcgttttcatcaaaccgggcagtggcaaaatcgttatcaaccaacgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgatgagtccctgcgtggcgaactgcgtaaagctggcttcgttactcgtgatgctcgtcaggttgaacgtaagaaagtcggtctgcgtaaagcacgtcgtcgtcctcagttctccaaacgttaatctgtttctgctcaggcagaatacagttggcgaaaaaacccgctccggcgggtttttttatgcctgaaaatttagttatccactgtaatagcttgattcctgcctctttttgagcaattgcgcaataccctcaccacaaagcccgcaaaatctggtaaactatcatccaattttgtgcccaaatgccggggatagttcattttttgtttaaatattgaacaatgaaatgtacccgggtggatagattacttacatctggcgagccacgttgtggtttgcagcagtaatattctgaatatacctggaggttttcatggctgtcgctgccaacaaacgttcggtaatgacgctgttttctggtcctactgacatctatagccaccaagtccgcatcgtgctggccgagaaaggtgttagttttgaaattgagcatgtggagaaggatcatccgcctcaggatctgattgacctcaacccgaatcaaagcgtaccgacacttgtagatcgcgagctgaccctgtgggaatctcgcatcattatggaatatctggatgagcgttttccgcatccgccgctgatgccggtatacccggttgcgcgtggtgaaagccgcctgtacatgcagcgtatcgaaaaagactggtactcgctgatgaacgttgtcgtgaacagcaccggtgctcaggcggataccgcccgtaaacaactgcgtgaagagctgctggctatcgcgccggtatttggacagaagccttacttcctgagcgatgaattcagcctggtcgattgctatctggcgccgctgttatggcgtctgccgcagctggggatcgaactcagcggcgcaggggctaaagagctgaaaggctacatgacgcgcgtctttgaacgcgattccttcctcgcttcactgacagaagccgaacgcgaaatgcgccttggccggggttaataagcatggaaatgtcacaactgtctccacgccgtccgtatctgctgcgcgcattctatgaatggttgctggataaccagctcacgccgcatctggtggtagatgtgaccctggaaggcgtgcgtgtgccaatggaatatgctcgtgacgggcagattgtgttgaatatcgcgccgcgtgctgtcggtaatctggagctggctaacgacgaagtgcgttttaacgcgcgtttcggcggggtgccgcgccaggtgtacgtcccgctggctgccgtactggcaatttatgcccgtgaaaacggcgcaggcaccatgtttgagccggaagcggcgtatgacggcgacgccatttctctcaatgacgatgacgagactaccacgcctgagggtgaaactgtcatgtccgttatcgacggcgacaagcccgataacagtgatgacaacgatcctgatgacgatccgccgccgcgcggtggccgtccggcattacgcgttgtgaaataaactgacaggccccgacgggcctgttttttttgcctttggtaacgccatcccgcaccaggtgcgccagcctgatattcctgtgttatgatgagcttgctgtcacacactacttatccgggcgctatgaacgcatttgatcctgactccgacaaccctgctgaaaaggtcgcgcgcacgctgcgtcgtcgtccgctggcgcgtaaaaagctctcagagatggtggaagaagagctggagcagatgatccgccgccgtgaagtggctgagggtgaacagctgccgtctgaacgtgaactgatggcgctgttcaacgttggccgcccgtcggtacgcgaggcgctggccgcgctgaaacgcaaaggcctggtgcagatcagcaatggcgaacgggcgcgcgtatcacgcccctcagccgataccatcgtcagcgaactctccggcatggcgaaagactttctctcgcgccccggcggtatcgcccattttgaacagctgcgtttgttctttgaatcaagcctggtgcgttacgccgccgagcacgccaccgacgcgcagattgaacagctcagtaaagcgctggaatggaacagccagacgctggacgacaacgcgctttttatccgctccgacgtcgagtttcaccgcgtgctggcgcaaattcccggcaaccctattttcaacgccattcatctctccctgcttgactggctgatcgccgcgcgtccggccgtaccggaaaaagagctgcatcagcacaataacgtcagttatcagcagcatattgagatcgtcaacgccatccgccagcgcgatccggatgctgccgatcgcgccctgcatacccatctgaacagcgttttcgccacctggcacgccttcgacaaaaagaaaaaatcccgcgcctgatcccgcattgccttaacgatcctcaaacgatcgtttagtgaggcagatcccattccctgcatttggggacaaaatgtcgattttgtgtgctggtataataggtataaaggtatatagtcaggcaatgataacccatcaggagaagttcatgtctgttcagttaaaaggcgttatgcccgccctgttaacccccttcgacgccagcgaaaatctggataccgaaagcctgcgccgtctggtgcgtttcaatatcagtcagggcattgatgggctgtacgtcggcggatccaccggcgaagcctttgtccagagcattaaagaacgtgaagaagtgctggagatcgtggccgaagaagcgaaaggcaaaatcacgctgattgcccatgtcggcaccgtcagcacgcgggaaacgcaacagctggcgacagctgccagccgttacgggtttgacgccgtctccgccgttacgcccttctattatcctttcagctttgccgagcactgtgaccattaccgggcggccattgatgctgccgacggtctgccgatggtggtttacaacatcccggcgctgagcggcgtgaagctgtcgctcgatcaaatcagtaccctggtcacgctgccgggcgtcggcgcgctgaaacaaacctcgggcgatctttttcagatggagcagatccaccgcgcgcacccggatctggtgctttataacggctatgacgagatcttcgcttccggtctgctggcgggcgcgaatggcggtattggcagcacctataacattatgggctggcgctatatggggattgtgcgcgcgctggcggaaggggatatcgccaccgcgcaacgtttgcagaccgagtgtaataaagcgatcgatctgctgatcaaagtgggggttttccgcggcctgaaaactatcctgcactacatggacgtgctgacggtgccgctgtgccgtaaacccttcggcccggttgatgaacaatacctgccagaactgaaagcgctggcggatcggctgcttgctgagaagtgctaacctgatgccgggcggcaacaggtcggcccggccatgaaaaacagaccgagcgtcgggagaatgttatgacaatgcctgcccagagcatcccgtggtatcgccatcttaatcgcagccagtggcgggcgttcagcgccgcctggcttggctatctgctggatggttttgattttgtattaatcgcgctggtattaaccgagatccagggcgaattcggcctgaccaccgttcaggcagccagcctgatttccgccgcctttatttcccgctggttcggcgggctgatgctgggggcgatgggggaccgctacggtcgccgcctcgccatggtcaccagcatcattttgttttctgtcggtaccctggcctgcggtttcgcgccgggctacaccaccatgtttatcgcccgtctggtgatcggcatggggatggcgggtgaatacggctccagcgccacctacgtgattgaaagctggccgaagcaactgcgcaataaagccagcggctttttgatctccggtttttccgtgggcgcggtgatcgccgctcaggtttacagcctggtggtgccggtatggggctggcgggcgctgttctttatcggcatcgtgccgatcgttttcgcgctctggctgcgtaaaaatattccggaagcggaagactggcagcaaaaacatgccggtaaagcgccggtgcgtactatggttgacattctctaccgcggcaaactgcgcattctgaatatcctgatgacaatagccgccgccagcgcgctctggtactgctttgccgcgcaaatgaaaaacgccgcgctggtgattgcctttggtctgctgtgcgcggcgatctttatcagctttatggtgcaaagcagcggcaaacggtggccgacgggcgtgatgctgatggtggtggtgctgtttgccttcctctattcatggcccattcaggcgctgctgccgacgtacctgaaaaccgaactggcttacgatccctccaccgtggcgcgggtgctgttcttcagtggctttggcgcggcggtgggctgctgcgtggggggctttctcggcgactggctgggcacgcgcaaagcctatgtttacagcctgctggcctcgcagttattgatcatcccggtattcgctattggcggcgccaatgtctgggtgctgggctttttactcttcttccagcagatgctggggcaggggatctccgggatcttacctaagctgatcggcggctatttcgataccgatcaacgggcggcggggctgggcttcacttataacgtgggggcgctgggcggcgcgctggcgccgattatcggcgcactcttcgcacagaaaatggagctgggcaccgcgctgggatcgctctctttcagcctgacctttgtggtgatcctgctgattggtcttgatatgccgtcccgcgtacagcgctggttgcggccggaagcgctgcgcacccatgacgccatcgatggcaaaccctttagcggcgcagtgacgcataacgcggacaaaagcgacttactgaaaacaaagcgggcggcgaaatgatcactctggctatcgacatcggcggcaccaaacttgccgctgcgctggtggacgcacacgggcgattatcctgccgcgccaccctgccgacacccgccagccgcacgcctgatgcgctggaggccgccctgcgcgatctgctgacgccgctctacccgcgtgcgcagcgcttcgccattgcctccaccggtatcattcaggatggcgtactgacggccattaacccggaaaaccttggcggactggcgcattttccgctggtggcctgcgtcgcgagcatcaccggcttgccgggagtggcgctaaatgatgcacaggcggcagcatgggcagaatatcagccgctggcagctcgtgtgcgtgacatggtgtttctgaccatctcgacaggcgtcggcggcggcctggtgcgtgatggcaggctggtcaccggacagggcgggctggcgggccatttcggccatacgctcgccgatccgctcgggccgcgctgtggctgtggacgtaccggctgcgtggaggccatcgcctccggacgcggcatcgcggcggcggcagagggcgaactggctggctgtgacgcgaaaaccctgtttgccctgagcgagcaggggcatgcgggagccagtacgctggtgaacagatcggcaaccgcgctggcacgcctgatcgccgatgtgaaggccgccaccgactgtcagtgcgtggtgctcggcggcagcattggtctggcacccggctatcttgcccgtgtgcggacggcgctgttacgcgaaccggcgatgtaccataccgaattactgactgcgcattatcagcacgacgccggactgctcggcgcggcctggtgggctaacgggagaaaagcatgatttacggagatattcaccagccggaagcggccggtttacccgccggattgctggatgcgctgcgccaggcgctggcattagcgccggagcagctatcccccggacggcacgaactcgccggtgcggcgtgctttatgaacgtgatgcattacagcacgcagttgccggacacaaaaaaggcggaactccaccggcagtatgtggatgtgcaggtggtgcttaccggggaagagcagattttttacggcgctgcgggcagtgcgcgcgagtgcgaagagtggcatgatgcagacgattatcagctgtgccagcacattgataatcagcagaggctgaccctgcgcgccgggatgtttgccgtatttatgcccggtgaaccgcataagcctggctgcaccatggggcgggagagcgaggtaaaaaaagcggtgattaaagttccctgcgaggaagccactggctgaaatgcgggggcgaaaaatatcgcccccgcatttattaccagcgatagttccagagaatatggccgccgtaagcgtcgtagctgttttcgccccattcgcccgtggcgcgtacggagagcgtcattgcttcattgagcttaccggtgatcccgacctcgaccagggcgcgatcttccggcacatcgttactcagcgtttcgccgttaaactgcaaatcggtcgcgccgtcgccgttaagccagttaaccgatgtccacggctgccagtctcccggcgctttctgattgaggttgctgacgcgtacgcccagacgggtcagaatgctgtccttgtcgctttgcgtaatgcgcgtaccgttaacctcggtatgatcgtcctgatcgagatagctgtagatgatctggccctgaggctcgatcttccagctgcgatcttcttcaccgctaaccagccaggcgtggcccatttccagcgaggcggcatagccgttgctcttgtaatcttcagagtcgaggccatcgccacgaacgtagccgtcataccagttagcctgcacccagctgtccacatagctgccggtacgtaactgtggatcctgctgccaggtggcatacagcccgacgttataaccgctgacttttcccttcgcggagttgcggttattagtggcatccgcatgcgtgacgctcagacctgcgccaagcataaagccggcatgcagttcgccttcatcataggtgcgggtatagagatcgctgccgacctggaagacggtggtggtggtgtcataaccgcctttcgcatccgctgcggtaccttcgttataacggcctttgacgtacatccagccattttgttcgccttcattacgcgccagcacctgctcgcgatcgtccagcttgtgcaggaacatttgctgtgcagcgctctggttagcaagataagcgctggtttccggacgaatgacttcaggggatttatcttcatcgccgttgccgttatcaccaccgttgccgttatcgccaccgttgccgttatcgccgccgttgccgttatcgccgccgttaccgttgtcgccgccgttgccgttatcgccgccgttaccgttatcgccgccgtcgccattgtcgccgccgtcgccgttatcgccgccgttgccgttatcgccgccgttaccgttatcgccgccttcgccgttgtcaccatcgccgttgtcatttggatcgggttctttttccgaaaccagataccagtctccatcgcgctttttaagatcgtattcccaggcacccgctacggcacgggatgagagagtgaatacggcatcggaagtctgcccaacctcaataatttcaatgccgttgattgtctgcgcgccctggccgccgatattggtcagcgccactttcgattcaccgctggtattaccggtgatggtcagcatgtccgtcgcggcgttgtcatccgccagggtggtattcattattagctggctgccggcattaccaacataatcaccattgatggtaaaacgctggcctggctgggtgtttgcgctgccaataatcagcgaaccgctgttgctgacgttaccctttatggaatccgcagtagcggaagcggtattacctgtcgtcgccacattccaggccgccagcgtgccgcccgccataatattcacgtcgcccgttaccgtaccggcactggccagggtggcgctattgttgatggtgacgctggcaggcgcagcggccgtgcccagcgcgctgtctttggcgaccagcgtggtaccgccattgagttcagtgccgccggtgtaactgaatacaccgtcaagcgtcagggtgctggcatcggatttaataagtttaccctggccgctgatatcactgctaaaggtggagtcgccgctctggttaattatcaggttgccgttattggtaactgcatcagaggtaaaggccgcagtgtgcgtagcatcccctagttgtaaggtagcaccctgattaatagtggtgccgccagcattgttcatggttccggtcagcgttaaggtgccagtagtgacctgcaggactttgtcattaattttctgagatccgttaccaagcaaatcaatgttaccactcaaggtccacgcctcgcccctcatattgagtgaagcgaatccgtcatcctcatgaaaaccaataaaattgctattttctgtcccagaaccttctaatataagtttattctttaatgattttgtactaagaacatcaccttcaaggttagagccactttgtaatacaagactattttgttcggaagattcaaactttattgcgtactgatttccatgaattgttccagcattacttatagaagaactaccatttccttttagcgctatccccgcatcattttcactggagattactgcgctatttatgatggttgctgaaccgctagttatttcaattgcacttccattagtggagctaataattcctttattatcggcggcaaaattatcgctggcaactattgcattttcagttccgcttatttttcccttttcataattattaacgttgatgcttgagccattaattatattaattgcgtaagtattgccgtcaattattcctttattggtgagttcacctttcattttattaatatcaatggcggtgcccgcgctattttcgatagtgccttcattgataacagaagtaataaagccatcattaatatttaaagttggcttagttgataaattaatatcaatagaagtttcactttcgatattataagaagtgtcagtgtcatctaataccccaggtgcggtgattgttgcagcaaacgccacagaagacgaacaaaaagcaatagtgggcattaattttaatattgttttggtaatcaaatttaattgatgcggtgtatacgacataattacttccgttgtaagaaatgaaataagcggggcatactattcttaagctttcattaagtaaacggttgcgactgtgtcgctatgccgatagttacaaataaccgtaattttaagagtgttttattagatatgtgaatgtgaactattgtaattattgacgtaaaaggaaggatcgcggttaaaagggaagtactaacaggaattattaacaggaggggtggggcaattattaactaaatatattgatcgcagaaatgaatatccgtggcagtgtattaacacaccgccacggttatagcttatacttccagccagttcataatgccttctgccgctttacgcccttcggcgatggcggtgaccaccagatccgaaccacgcacgatgtcgccaccggcaaagattttcggattgctggtctggaaggcattttcattaccttccggcgcaatgatgcggccctgcgaatccagctcgacgctgtgtttcgccagccattccatgctgtgcggacggaaaccaaacgccattactacggcatcggccggtaacacgtgttcagagcccggtacgatctctgcacgacggcgaccatgggcatcaggcgcgcccatctccgtgcgcgccattttcacgccgctcactttgccgttggcattcacttcaatgcccagcggctgcacgttgaactggaactccacgccttcttcacgcgcgtttttcacttcgcgacgggaacccggcatgttctcttcatcacggcgataagcacaggtaacgtgcgtggcgccctggcggatggacgtacgtacgcagtccatggcggtatcaccgccgcccagcaccactacgcggcgaccttccatgctgacgaacggcgcgtccgtagtttcaccaaagcccatcagctgtttagtgttggcgataaggaacggcagcgcgtcgtacacgccggacgcatcttcattctccagcccaccgcgcatcgactgataggtgccgacgcccaggaacacggcatcataatctttcagcaaatcctcaagctgtacgtcgcggcccacttccacgttcagtttgaattcaatacccatgccggtgaaaatttcacggcgacgggtcatgacttctttttccagcttgaaggccggaataccgaaggtcagcaggccgccgatttccgggtgacggtcaaagaccaccgctttcacgccgttgcgggtcagcacgtcggcacatgccagacctgccgggcctgcgccgataatcgccacgcgcttatcggtctgacgtacaccggtcatgtccggacgccagcccatttcaaacgctttatcattgatatagcgctcaatgttgccgatggtgaccgcgccaaactcgtcgttaagcgtacaggagccttcacacaggcgatcctgtggacacacgcgaccgcacacttccggcagggtgttagtctgatgcgacaattctgccgcttcaaaaattcgcccttcgttggccagcttcagccagttaggaatgtagttatgaaccgggcatttccactcgcagtagggattgccgcaggacaggcagcgatctgcctgtgctttggcctggccttctgaaaacggctcgtaaatttcaacaaactctattttacggatcttcagcgcttttttcggcggatcaacgcgctgtaagtcaataaactgatagacattctgactcattgcttccccttactgcgcctgcacccgcagctcagctgcggaacgactacggtgacccaacagtgctttaacatcgctggacttcggtttaaccagcgcgaatctggtggagaatgctggccagttcgccaggatctcttcgccgcgtgaggagcccgtgtgctgcacgtgctcggtgatcaaaccgcgcagatgctcttcatggatggcaagatcatcgacgctcagcacttccaccagctccgggtttacacgcttacggaattcgccgtcttcatccagtacgtaagcgaagccgcccgtcataccggcaccgaagttaacgcccgttttacccagaatgcagacaataccgccggtcatatattcacaaccgttatcgccaatgccttccaccacggtgatggcaccggagttacgcacagcaaaacgttcacccgcgcggcctgcggcatacaggcgaccgccggttgcgccatacagacaggtgttaccgataatgctcgccttatggctgaggaaagctgaacccaccggcggacgtaccgccagcagaccgcccgccatgcctttgcccacgtaatcgttagcatcgccggtcagatacagctccacgccgccggcgttccacacgccaaagctctggcctgcggtaccgctgaagtgcgctttgatcggatcggctgccagtccctgatcgccatgcttctgggcgatataaccggacagcgacgcgccaacggagcggtcggtgttgcgaatatcgaaccagaaggttttgctctggccttcatccacataaggttttgcctgtgacagcaactgggcgttcagcacgccgttatcaaacggcgggttgtgctcggtgcagtacagcgctttaccaggatgcggctcggcggtttccagcagtttgctcagatccagcttttgctgcttagcggtataaccttccagcgcgatcagcagatcggtgcggccaatcagatccaccagacgtttcacgcccagttgcgccatcagctcgcgggtttcacgggcgataaattcaaagtagttggtcactttgaacggcagaccgtggtaatggtttttacgcagtttgtcatcctgggttgccacgccggtagcgcagttgttcaggtggcaaatacgcaggtatttacagccgagcgcgaccatcgggccggtgccaaagccgaagctttccgcgccgagaatggcagctttaataatatcgacgccggttttcaggccgccgtccacctgcaggcggatcttatggcgtaagccgttggcaaccagcgcctgctgggtttccaccagccccagctcccacggacagcccgcatatttcacggaggagagcgggcttgcgccggtgccgccatcgtagccggcgatggtgatcagatccgcataggctttagccacgccggtggcgatagtgcccacgcccggctcagacaccagcttcacggaaatcatcgctttcgggttgacctgttttaagtcaaaaatcagctgcgccagatcctcaatggagtaaatatcgtggtgcggcggcggcgaaatcagcgttacgccaggcacggagtagcgcagtttggcgatgtacggcgtgactttatcacccggtaactgaccgccttcgccaggcttcgcgccctgggccactttaatctggatcacatccgcattcaccaggtaggccggggtaacgccaaagcgtcccgaagccacctgtttgatgcgcgacactttattggtgccgtagcgcgccggatcttcaccgccttcgccggagttggaattgccgccgatgctgttcatcgcttccgccagcgcctcgtgcgcttccgggcttaacgcgccgatggacatggctgccgtatcgaagcgtttgaacagttcctgcgccggttccacgtcgtcaatgctgacggcgtcggcaggcggattgatagccagcagatcgcgcagcgtcgccgccgggcgttcgttaaccagtttcgcatactgctgatagtcgctgtactcgccggtttgcaccgcctgttgcagcgtgcgcaccacgtccgggttataggcgtggtattcaccgccgtgcacatatttcagcaggccgcccgcatccagcggtttacgcgccagccaggcacgcttcgacaggttcagcagatcctgctggaagtcgctgaagcttgcgccgccgatacgactgatcacgccctggaagcagaggttcgccacatcgtcatgcagaccgaccgcttcgaacagcttcgagcagcggtaagaggcgatggtcgagatgcccattttggacatgatcttgtacagacctttgttgatgccgttacggtagttcagcatcacggtacggtagcttttctcaatggcgcgggtatcgatcagtttcgccagggtttcataggcgagatacggatagatagcggtggcgccaaagcccagcagtacggcgaagtggtgcgggtcgcgcgcgcttgcggtttcaacaatgatgttggcgtcgcagcgcagatttttttccaccaggcgagtctggatcgcgcccactgccatcggcgccggtaccggcagacgatctttggcgatgttgcgatccgagagcaccagcagcaccgtgccgtcgcgcaccatggcttcggctttatcacacagcgctttgacgacctcttcaagcgtgctttcattcacgtcaaaggtgatgtccagtgtgtcggcgcgatagtgatgctccgtcatggtggtgagctgtttgaaatcggagtacagcaggatcggcgatttgaaactcaggcggtgcgcctggccttctgcttcacagaagacattcatctcgcggccaatgctggtggccagcgacatcacgtgcgcttcacgcagcggatcgattggcgggttggtcacctgcgcaaactgctggcggaagtaatcgtaaatgatgcgcggctggctggagagtacggcaaagggggtatcgtcacccattgaaccgaccgcttcctggccgttttcacccagcacgcggatgatggaatccagctcttccgcgctgtagttaaactgtttctggtagctgcccagcagatcgtcgcccatttcgcggctgccgacttcttcgtcaggcagatcttcaaagggcaccagacggcggacgtttttctccatccactctttgtaggggtgacggcttttcagatcgtcatcggtttccgcagagtgcagaatacggccgccgcgggtgtcgatcaccatcagctcgcccggccccacgcggcctttttccaccacctcgtccggctgataatcccagatgcccacttcagaggcgcaggtgatcagcttatctttggtgataacgtagcgcgccgggcgcagaccgttacggtcgaggttacaggcggcgaaacgaccgtcggacatcacaatgcccgccgggccatcccacggctccatatgcatggagttaaagtcgaagaacgcgcgcagctccggatccatgtccgggttgttctgccaggctggcggcacgagcagacgcatggcgcgcacgatgtccataccaccggcaagcagcagctccagcatgttatccatggagctggaatcagagccggtttcgttgacgaaaggcgcggcatcgtgcagatccgggatcagcggcgtctggaacttataagtacgcgcgcgcgcccactgacggttaccggtgatggtattgatttcaccgttgtgcgccagatagcggaacggctgcgccagcggccagcgcggcacggtgttggtggagaagcgctggtggaacaggcaaatggctgattccaggcgcaggtccgccaggtccaggtaaaagcgcggcagatccgccggcatacacagacctttataaatgttgaccaggttcgacaggctacaaacgtagaaatctttatcttccaccagacgcttttcaatgcggcggcgcgcgataaacaggcggcgctccatatcgcgtggacgccagcccgcaggggcgttgacaaagatctgctcaatacgtggcagcgaggagagggcgatttcaccgagcaccccttcattggtgggcacgtcgcgccagccaacaatcgacagggtttcctgttgcagctcttcttctacaatacggcgcgaggcggcagctttttcaggatcctgattcaggaacagcatgccaacggcgtagtttttggccagccgccagccgcgctcttcggcaacgatgcggaagaaacggtcgggtttttgcaacagtaaaccgcagccatcgccggttttaccatcggcaaggatcgcgccacggtgctgcattcgggccagtgcgtgaatagcggtacgcactaccttgtggctaggttcgccttctatgtgggcgatcaggccgaaaccacagttatccctctcaagggatttatcgtacaacatatcagtgaacctccccaggctctacgggagtccgtcttaaccgacgcgcacaggcgcagaaagagcatggcgacggggctttaaggcctcgggtgtcgccctcttttttttccttttcgcatcggtacacaagtgttgaggacttgctttaagagggaatctcaattactgcatatcacttcatccttcggaccgcctcatcgttggctgccttcgttcatcccagtcacatagtggactatgctcctgtgattcactcagttgccgccttgatgcagcccgaatgattttgtgcataaatatgatgagcagactgctcacccagaaagcttccagcggatcctcaagttatcgggaatcggcacacaggtcaaatggcaatcttatttatacaaaaatgtgctaaaggttggttaactagttgtttttaatgttttttaatgctctttttgccactatgtcaggcctggcggccgttaatggagtgtgatccctctcactataagaaagcgctgttattaccgcgctgtcctgcgttctgttttgcaaacagaatattacactggcttttcttcctaacccgcttaatgccactgttttgcgccgaaggaattctttttgaaaaatatcccgccgacataagtaaaagtaatcagcgaagcagtgaatgaaatctcggtaattgtgcgtgtttatgcaatagatgtgcgtcctctatggcgattgatccaggtcatcgccgacaaagactaaaaatggcaggcttggccctttcatcaggccggtctatcaatttatgcagttacagaaattagtcaatatgtttggtggcgatctcgcccgtcgttacgggcagaaggtccataaactgacgctgcatggcggtttcagttgtcccaatcgtgatggcactatcggacggggcggctgcactttctgttacgtggcttctttcgctgacgaaacccagcagaaccactccattgcggagcagctggcttatcaggccacgctggtcaaccgcgccagacgatatctcgcctattttcaggcctacaccagtacctgggcggaagtgcaggtgctgcgcgccatgtatcagcaggcggtaagccaggccagcatcgtcggtttatgcgtcggcacccgcccggactgcgtgccggatgcggtgctggatctgctcagcgaataccatgacgcgggctatgaagtgtggctggagcttgggctgcaaacggctcaggataaaaccctgcaccgcattaaccgcggccacgattttgcctgctaccagcacaccacccgccgggcacgcgaacggggtctgaaagtgtgcagccatttgattgtcggtctgccgggagaagggcaggccgcgtgtctggacacgctgcaccgggtggtggagacgggcgtggacgggatcaaactgcacccgctgcatattgtcaccggcagcaccatggcgaaggcctgggaagcggggcgtctgcacggcattgcgctggaagactacaccgtcaccgccggggagatgatccgccatacgtctcctgaggtgatttaccaccgtatttccgccagcgcgcgtcgcccgacgctgctcgccccgctgtggtgcgaaaatcgctggaccggtatggtggaactggaccgctaccttaacagccacggggcgcagggatcggcgctgggccgcggctgggtgcagccatgcgtctgaacgtttccttcctgagcggggaataattcgcactttttcacacaagcgtcaacgccttgctcagaattgagtattattgtgccaggttgtcgcgaagggatcccctatgaagcaaatccgagtactggcgcaatactatgtcgatctgatgatgaagctcggcctggtgcgcttttccatactgctggcgctggcgctggtggtactggcgattgtcgtgcagatggcggtcaccatggtgttgcatggccgcgttgaaagcattgatgttatacgctctatcttctttggtctgctcattaccccctgggcggtctactttctgtcggtggtggttgaacaactggaagaatcgcggcagcggctctcgcggctggtggataagcttgaagagatgcgcgaccgcgatctcaagctcaacgtacagctgcgggataacatctcccagctgaatcaggagatcagcgaccgtgtgaaagcggaagcggagcgccaggccactttcgagcagctaaaaatcgaaatgcaggagcgcgaacagacgcagatccagctggagcaacagtcttctttcctgcgctcgttcctcgatgcttccccggatctggttttctatcgcaatgaagataaagagttttccggctgtaaccgggcgatggagctgctgaccggcaaaagcgaaaaacagctggtgaatctgaagccgcaggacgtctattccccggaagctgccgagaaagtgctggaaaccgacgagaaagttttccgccataacgtgtcgctcacgtatgaacagtggctggattacccggacggacgtaaagcctgttttgagatccgtaaagtaccctattacgaccgcgtgggtaaacgccacgggctgatgggcttcgggcgtgacataaccgaacgtaagcgctatcaggacgcgctggagcgcgccagccgcgacaagactacctttatctctaccatcagccatgaactgcgtacgccgcttaacggtatcgtcggtctgagccgtatcctgctggatacggagctgaccgccgaacaggaaaaatacctgaaaaccatccatgtttcggcggtgaccctcgggaatattttcaacgatattatcgacatggataaaatggagcggcataaagtccagctggataaccagccggtggacttcaccagcttccttgccgatctggaaaacctctccgggctacaggcgcagcagaaagggctgcgcttcgtaatggagcctgcgttgccgttgccgcataaggttgttaccgacggcacgcgtctgcggcagatcctgtggaacctcatcagtaacgccgtcaaattcaccctgcacgggcaggtggtggtgcgggtgcgctatgacgctccgcaggagatgctgcgctttgaggtggaagattccggtatcggtattccgcagaccgaacaggataagatcttcgccatgtattatcaggtgaaagacagccacggcggtaaacccgcgacggggacgggcattggtctggcggtatcgcgccgtctggcgaagagcatgggcggcgatatcacggtgtccagcgtggcgggcaaaggttcggtcttctcgctgtcggtgcgcgcccctgctgttgcggaagaagtagacgatgcgttcgaagaagatgaaatgccgctgccggcccttcacgtcctgctggtggaagacattgagctgaacgtgattgtcgcccgttcggtgctggaaaaactgggttgcagcgtggatgtggcgatgaccggcaaggcggcgctggagatgtttacccccggcgaatacgacttgctgctgctggatattcagctgccggatatgaccgggctggatatttcccgccagctcaccagccgctatgcggctgaagatctgccgccgctggtggcgctaaccgccaacgtgctgaaagacaaacaagaatacctgaacgccggtatggatgatgtcctcagcaaaccgctggccgtaccggcattaacggccatgatcaaaaaattctgggatacctgtgacgacgaggagagtgatgtgacccctgtggatgacagtaaatcacaagcgctgctggatctgccgatgctggaacagtatctggagctggtggggccgaagctgatcaccgatggcgtggcggtatttgaaaaaatgatgccgggctatatcagcgtgctggagtccaatttcaccgcccgcgatcagaaaggcatcaccgaagaagggcataaaattaaaggcgcggcaggatcgattggcctgcgccgtttacaacagctggggcaacaaattcagtcgccggatctgcccgcctggtggaataacgtgggcgaatggatcgacgagatgaaacaggaatggccgcatgacgtggcgttactgaaagcctgggtggcgaatgccagtaaaaaataaccccggataaaccggggtgcgcgaatactgcgccaacaccagggaaccgtggctgcgccgggattgtgattttgtagttgaacgggcacggcgagacatgagaaaagttggcacttaagataccaaaacttgaatcatttgttacgtgaatcagttaaatgtgtgaagcacagcgttgttatcacaataattaataaaattcagcctattgccagaaaggatgagcagcatgaaaaaagtaggtattgtccttagcggatgcggagttaacgacggatcagagatccacgaagccgtactttctctgctggcgatcgcccgaaacggtgccgaagccgtttgttttgcgccggataaaagtcaaagcgatgtggtgaatcatttgactggtgaatctatggcggacagccgcaatgtgctgatcgaagcggcgcgtattgcccgcggcgccattcagccgttagccctggcgtccgctgatacgctggatgcgctgatcgtacctggcggttttggcgcggcgaaaaacctgagtaattttgccagccagggggcggaatgcaccgtcgaccccgatctgaaacgtctggcgctggcgatacatgcggcgggcaaaccgctgggctttatctgtatcgcgccggcaatgctgccaaagattttcgacttcccgctgcgtctgactatcggcacggacattgacacagctgagttgctggaagagatgggcgcggaacatgttccctgtccggtggatgatattgttgtggatgaagacaataaagtggtgactaccccggcttatatgctggcgcagaatatcgcggaagcggcaaccggcatcgataagctggttgcccgcgtgctggttctcgcggaatgaaacggcgacgcgctccgctgatggcgacgttaaaatcctggctatggaggatcctgctggtgctgatcctgttctggggcggcggcatcgcgctgttttccttcatgccggtgccgttttccgcggtaatggcggagcgccagctttcggcctggctgagcggaaatttcggctacgttgcccattctgactgggtcggcatggacgatatttcgccgtggatggggctggcggtgatcgccgcggaagatcagaaattccctgaacactggggttttgacgtggccgccatcgaaaaagccatctcccacaacgaacgtaacgagaaccgcattcgcggcgcgtcgaccctttcccaacagacggcaaagaatctgtttctgtgggacgggcggagctggctgcgtaaagggctggaagcgggcttaaccctgggcatggaaacggtatggagtaaacgccgcatcctgacggtttacctgaatattgcggagtttggcgacggagtgtttggcgttgaagcggcggcacaacgttattttcataagccagctagccgtctgacgatgtcggaagccgcgctgctggcggctgtgctgcccaatccgctgcgctttaaggctgatgcgccctcaggttacgtgcacagtcgacaggcgtggatcatgcgtcagatgcgtcagctgggcggtgaaggctttatgcgcgaccagggactgtatcagtaatcttccccctctccggcaaggcggggggacttatcagtcttcgtcaaacccggcattaaacagcgcgatcaccgccgccagcgcctcttcttcctgcgggccggtggcttcgatctcaatctgacggcctttcgccgaatccagcatcagcagcgcgatcacgctgttcgcttctgcttctgtcccttcttcattgcgcagcagaacttctgcgtcgaagccctgcatcagttcaaacagtttcatcgccgggcgggcgtgcatgcccagcttgttagtgatttcaacggtttgctttacggtcatgatttgcgtttttccagcgtacgatggcgggattgcacatttttgccgcgcgaacggaagtaatccgccagctgttcagcgatatacaccgaacggtgcttgccgccggtacaaccaatggcaaccgttaggtagctgcggttattggtttccagcatcggcaaccacagttccagatagctgcgcgtctgatagataaagttatgcacttcagtatggcgatcgagaaacgccgccacgggcttatccaggccggtcatcggacgcagtttgggatcccagtgcgggttcggcagaaagcgcacatcaaacacgtagtcagcatcaataggaatgccgtgcttgaagccaaaggactcaaagaccatcgtcagctcacgctcgcgtttgcccagcagacgcgtacgcagcatttcggccagttcgtgcaccgacatttccgaggtatcgacgatcagatcggcgcgggagcgcagcggctccagcagatcgctctcttcgtcgatggcgctttccagcgacaggtttttactggacagcggatgcagacgacgggtatcgctgtaacgacggatcagcgtattgcggtcggcatcaagaaacagcagttgcggagaaaacgcatcgggcaggttgttcatcgcctgttcgaagatctccggcgattccggcatattacgcacatcaatgctcaccgccgccgaaatctgacggtcagcaagcgagcgcgccagttctggcagcagcacgacgggcaggttatcgacgcagtagaagcccatgtcttccagcgctcgcagggcgacagatttccccgatcccgaacgaccactgacgatcatcagtaccatgtaccctttctcctccggacaacaaagacgaaggccatttcctggttaagcatcatcccgggagccttctgtttccgtgatgatttgataaagttcttcatcgctttgcgcgctgcgcagacggcgacaaatggttttatccgccaggcggcgggcgactaaagagagcgtatgcagatgcgttttggtctggtcggccggcaccagcagcgcaaacagcaaatccaccggctggttgtcgatagcatcaaaggcgatcggcgtttccagctgcacaaagacgcccacagcgcgcagcgtatcttcctccagcttaccgtgggggatcgcgataccgttgccgataccggtgctgcccattttctcacgcgtcaaaatcgcctcgaataccacctgcggcggtaagcttagctgtttggcggccagttcactgatgatttccagcgcacgttttttgctctggcagtgaacgccgctgcgggtacattcctggttaaggacattgctcaattgaagagctgaatcgttgttcatcataatttcacctaagcgctaacggtacaaagggcccgttgtgtctcacaacaggccgtcctgcacccgttaactgcccggacaattagtgttgtttcagtttatctttatgtttagtgagctgccgtgaaagtttatcaattaaaccatcaatggcggcatacatatcctgcccttccgcactggcgtggatctctccgccgttgacatgcagggtggcgtcggcgatatgcgtcaccttttccaccttcagaacaatgtagacctgattgatcctgtcaaaaaattgctccagcttggcaaattttgtctgtaaaaattcgcgcaagggctcagtaatctcgacgttatgtcctgtgatattgagctgcatagtgtcttccttatcggttgagtcagaccagctgtttacgctggttagacggcggaatggataaagactctcgatacttcgcaacagtgcggcgcgctaccatgataccctggtcggacagcagggtagttagcttactgtcactcagtggtttcgcagggttttctgcggctatcagtttcttcaccagcgcgcgaatggcggtggacgatgcttcgccgccgctgtcggtattcacatggctggagaagaaatatttgagctcaaaaatgccccgtgggctgtgcaggtacttctgggtagtcacacgtgaaatggtcgattcgtgcatctcgacggcctgggcaatgtcggccagcaccatcggtttcatatattcttcgcctttatcaaaaaaggcctgctgctgctcaacgatacagcggctgacgcgcagcagcgtgtcgttacggctttccagacttttgatcagccatttggcatcctgcaaattactgcggataaactggctgtccgcgtcattacgcgatccgccgcacatggcggcatagtgctgattgatttgcaggcggggaatgctgtcggaattaagctcgacagtccagcgcccctgatgcttacgtaccagcacgtcagggataacatattcgggttcgcccgtctggatcgactggccgggtcgcggatcgagcgactggatcagattgacggcttcttttagcacatcttctttcagccgcgttacgcgcatcagagatcggaaatcatggttcgccagcagatcaagatgatcgctgatgatcaactgcgcttcgtcgcgccagggcgtgtctttgctaaattgcgacagctggatcagcaggcagtcacgcagatcgcgggcggcaacgccgatcggatcaaaacgctgtacgcgcttgagcaccgcctcgacctcatccagcccgatctcctcatcgcccatgctttcaagaatatcgtccagcgagacggtgagataaccggtgtcatcaacggcgtcgacgatggaggtggcaatggcgcgatcggtatccgagaagggggtcagttccacctgccacatcaggtaatcctgcagggactgggtggtttcaccctgataaaccggcagttcatcatcctgataatcgacaccgttacccgaaggcgtaccggcggtgtagatctcgtcccagctggcatccagcggcagctcgtcgggcatctctttctgttcaagggcgtcgacggcgtccaggttttcggtgtcctgtgtcggttgggcgtctatctcatcgtgaagatcggtttgctccagcaacgggttgctttccagcgccagctgaagctcttgctgaagttccagcgtagacaattgcaacagacggatggcctgctgcaattgtggcgtcatggccagttgttggctgagccgtaattgcaaaccttgcttcatattcagagcagtcttctccgcttaaaccctttattttctctaccctatcagagtctgaagccttccccaagatatacgcgcttaacctgttcgtcttcaaggatttgctgcggcgtaccatgggcaatcaggtgcccctggctgacgatataagcccgctcacacacggccagggtttcgcggacgttatggtcggtaatcagcacaccgaggccgctgtcgcgcaggtgctcgataatacgtttgatgtcgataaccgaaattggatccacgcccgcaaaaggttcatccagcagaataaatttcggatccgcggccagcgcgcgggcgatttccacacggcggcgttcaccgcctgacaacgcctggccgaggttatcgcgcaggtgttcaatgtggaactcttccatcagctcattggcgcgatcttcacgctgttgcgaggtcagatcgtcacggatttgcagcaccgccatcaggttatcgaacacgctcagacgacggaaaatcgacgcttcctgcggcagatagccgatgccgcgacgagcgcgggcgtgcagcggcagcagactgatgtcttcatcatcaatgataatgttgcccgcatcgcgcggcacgatgcctaccaccatgtaaaaggtggtggttttacccgccccgttagggcctaacagaccgacaatttcaccggatttaacggtgaggctgacgtcttccaccacgcggcggcctttgtaagctttagcgagattttttgcagttaaagttgccataacggatcagttactctttttttgtgccggagccggggttgcgcttttgtcctgcagttgcgacggcaccagaacggtggtgacgcgcttacctttctcgctgtaagcctgcattttctgctctttcaccagataggtaattttgtcgcctttgatgttgctgtcgagctgctcaaggaaggcatcgccggtcagcaccacgaagtcattttgcagttcatagtgcaactgagaggcatggccttttaccggcttgccgctatcctgcatctggtagaaagtggctggcttgccgaagccgtcaatcacttctttaccttcttcgccgccgggacgcgtcaccaccactttatcggcattgattttgatggtgccctgggtgacgacaacgttgccggtgaaggtcacgacgttgccctgcatgtctaacgattgctgatcggattcaatgtgaatgggctgatcggtatcaccggtcagcgcaaacgcgggaatgctggcggccagaagcgtactggcaagcataaggttaaggctgagtttgtttgttttgaatttcatatgaggttctaaccttttcaatcagctcggcgtttttgctgcgtaagttgccgcgcattttcaggccgctggaattaaatgtcgtaccgtacaacgtaaccagatcgtttgacgtcacatcctgagtgatcaggttaatctgggcgttatccgtggtgattttacgcagttgagcatcagcggtcagggcgttgacctcaacgtgtccataaagataaagcatccggtcatcggtcagtttggccttatctgccttaattgaccatgtaggaattttgtctttgtcgaaagtcgtcaacaccggctgcgtgaaccacgacagcgcctggtcggaaaaatattcaacatgctgcgcgatcaggcggtaattcagcgccccttccgggctgtaaaccaccgtgtccgtgtgctcgctgcggtaggtcggctcattggtgtttgccaccacctgctctgtgtcgtctctgtctgccagattaatgccaatcagcaccagtattaccagcgacagcagaatgataacccaacgtctggttttactcatattgattgccctgtggctgcttcaagtttgccctgcgccagtaacagcagatcgcagacttcccggacggctccgcggccgccattaatgtaggtcacgtaatcggcacgcgggatcagcatcgggtgcgcatcagcgaccgccacgctcagacccacgtccgccatcaccggccagtcaatgagatcgtcgccaatataggccacttcatcggctgataccgccagatcggaaagcagctgtttaaacgcaatgcgtttatcggactgcccctgatacagatgcgtaatgccgagcgtaacgcagcgatcttctaacagtttagccttacggcccgtaattatcgccacctcaataccggaggtgagggcgcaacgaatgccataaccatcacggacgttaaacgcctttaactcttcgccgttgttgcccataaaaatcagtccatccgacatgacaccatccacgtcgaggatcagcaggcggattttctccgcctttgccatcacttgcgcgctgacgggaccgtagcaggttgcaagtgaagcaccagcgttactcattctttttatccttattacactacgcctgcgcgcagtagatcatgcatatgtaccacacccagcaactggtcgccatcggcaaccataaccacggtgatgtggcgggactgcatcaggttgagcgcgtcgaccgccagcaccccggaacgtacgcgaataccgccgggagtcatgacgtcagcaatgccgagattgcggacatccgcgcccatatcgaatacgcggcgtaagtcgccgtcggtgaaaataccttcgattttcatcaaatcgtcgcagatgaccgtcatgcccagatttttgcgtgtgatctccagcagcgcatcgcgcagcgtggcgtctttgctgacgtgggggatctcatcgccggtgtgcatgatgtcattcacccgcagcagcagtttacggccaagggcgccgcccggatgggaaagcgcgaaatcttccgccgtaaagccgcgggcctttaacagcgccaccgccagcgcatcgcccatcaccagcgccgcggtggtgctggaggtcggtgccagccccagcgggcaggcttcgcgcggtactttaacgcataaatgaatgtctgccgcccgcgccatactgctttccgggcggctggtcatgcagatcagcggcacctgcaaacgctttaataccgggattagcgccaggatctcgttggattcgccggaattcgacagggcgatgacaatatcctgcggcgcgaccatccccagatcgccgtgcgccgcttcgccgggatgcacgaagaacgacggggtgccggtgctggcgaaagtcgccgccattttgcgggcgatatgacccgatttgcccatgcccatcaccacgattttaccggcgcagtagaacattttttcgcaggcttcgctgaagtcctgattaatgtactgatcgagatgtgccaggccttcacgttcaatatccaggacatccttacctgcctgctgaaagtcaaagcccggcggcaaatctatttgcgacatattcagttcccattaaccggtaaaaaaaggcgacagccagtagagcatcgccatccaaaggataaagccgccgatcaacagcgcgcccgcgcctttacccgtctgacgccgtggacgccagcacaacagggcgaaaatcacgctgaccaccagcattaccccataatcacggctgaacgcgagcgggttaaacgcgccgggggcaataagcgccggcaggcccagcacgatagctaaattgaaaatattggaaccaataatgttcccgatggcgatgtcatcttcgcctttgcgggcgcccgcaatcgccgtcgccagttccggtaagctggtgccaatggcgatgacggtcagcccgatggtcagctcgctcatggcaaagaagttcgccagcacggtggcgttatcgatcaccatgcgggtggccatcggcatgatgatcagcgccacgcctaaccacaaaaaggccaccgacaggctgccttcgcggggcaactcggcgatctgctcgcgggtcaggctgtcattgccctgacgttcggcgaggcggcctattttcacaataaacagcagccatgcaaccgccagtaatagcaggaagatcccgtccagacgggtcaggctgccgtcatagagcacgctgcctgccagcaggctcatgattaacattagcggcaattcgcgacgcagaatatcagaatgtacggtaaaaggatggagcagggcggcaaggcctaagatcaacagaatgttgacgatgttggatccgatcgccgtgccgatcgccagatcgatctgcccgtgcatagaagcggcggcggaaacgatgatttcaggcagcgaggtgccgatactgactaccgtaaggccgatgacaagcggcgggatccccagactgcggcaaaggatagatgcggcaaacaccagacgatcggcactgtagaccaccaaaagtaaaccaattattaacagcgccgtggctaaaagcatctaaagtcctttcttcaggtataatcatcggcccgctaccacgatcgtctggcaggattgggatcgtaaaaccaatgatttcctaattttgactttatgcggcttaaaagtaaaacaaatgccagctttcgctaaccacagcgagtaatattctgtaaaaatgttgggttcagggtgcgacaacgcgaaatgcttacccctaacaaggctaaaaggatcagtaaatgagccagactgtggcgaatttagtcgatgtccgaggcgtcagcttctcacggggcagccggaccatcttcgacaatatttcgctgacggtcccgcgcggaaagatcaccgcgatcatgggtccgtcagggatcggtaagacaacgctgcttcgcctcattggcggtcagatcccgccggatgccggtgagatcttatttgatggcgaaaacgtgccggagatgtcccgcaccaggctgtacaccgtgcgcaaaagaatgagcatgctgtttcagtccggggcgctgttcaccgatatgaccgtttttgataacgtcgcctatccgttgcgtgaacatacgcctttgcctgcgcccttgctgaaaagcacggtgatgatgaagctggaagccgtcgggcttcgcggcgcggctaaactgatgccgtctgaactgtcgggcggcatggcgcgtcgcgcggcgctggcgcgggccatcgcgctggaacccgatctgatcatgtttgatgagccttttgtcggccaggatcccatcaccatgggcgtgctggtaaagctgatttcagaactgaacagtacgctgggcgtcacctgtatcgtcgtctcccatgacgtaccggaagtgctgagcatcgcggattacgcctatattgtggcggacaaaaaaatcgttgcccatggcagcgcgcaaggattgcaggagaatgccgatccccgggtgcgtcagttcctggatggcattgcggatgggccggtacctttccgttttcctgctggcgattatcttcacgatttattaggaacagggagttaatccactcatgctgttaaattcactggcttccctcggacagcgcggcatcagtatgctcgccacgttcgggcgcgccgggttgatgttattcaatgcgctggtcggtaaacccgagtttcgcaagcatgcgccgctgctggttcgccagctttataacgtgggcgtgctgtcgatgctgatcatcatcgtgtccggtttttttatcggcatggtgctggggttgcagggctacctggtgctgaccacgtatagcgcggaaaccagtctcggtatgctggtgtccctttcgctgctgcgtgaactcgggccggtcgtcgccgcgctgctgttcgctggcagggccggttctgcgctgaccgctgaaatcgggctgatgcgcgccaccgaacagctttctagtatggaaatgatggccgtcgatccgctgcggcgggtgatttcaccgcgcttctgggcgggggtgatctcgctgccgttgctgacgattattttcgtcgccgtcggcatctggggcggttcgctggtgggcgtgaactggaaaggcattgatgccggcttcttctggtcagcaatgcaaaacgccgtcgacctgcgtctggatctggttaactgtctgattaagagtgtggtgttcgccatttcggtaacctggattgcattattcaatggttatgatgcaattccgacctcagcagggattagccgggctactacacgtaccgttgtgcactcatcgttgaccgttcttggcctcgattttgtgctcaccgcactgatgtttgggaattgagtgatgcaaacgaaaaaaagtgaaatttgggttggcgtgtttttgctgatcgccatgctggcggcgctgtttgtttgtctgaaagcggcggatgtgacctctttgcgcagtgaaccgacgtaccgtatttatgccactttcgataacatcggcggcttaaaaatgaactccccggtgcgtatcggcggcgttgtcgttggacgggtcgcggatattacccttgaccagaaaacctatctgccccgcgtgtcgctggatattgaagagcgctacaaccagatcccggacaccagctcgctggcgatccgcacctctggcttgctgggcgagcaatatctggcattaaacgtcggctttgacgacccggagctggggtcttctatgcttaaagaaggcagtacgatccaggacaccaaatcggccatggtgcttgaggatctgatcggacaattcctttacaacagcaaaggaaacgataataagccatcagaggatgcgccaacgccggatgccgctaatactgatgcaacggcacctgctggcccgacgattcattgaggagaattaacgcatgtttaaacgacttttaatggtagcaatgctggtgattgccccgctgactgccgccactgcggcggatcagagcaatccttacaatatgatgcaggaagcggcgaaaaagacctttgatcgcctcaaaaacgaacagtcgcaaatccgttccaatccggattacctgcgtcagatcgtcgatcaggagctgctgccctatgtgcaggtaaaatatgccggcgcgctggtgctgggtcgctactacaaagaggctaccccagcgcaacgtgacgcctactttgctgcgttccgtgaatatctgaagcaggcctatggccaggcgctggcgatgtaccacggtcagagctatcagattgccccggaaaaaccgctgggcgatgcgactatcgtgccgatccgcgtcaccatcatcgatcccaacggtcgtccgccggtgcgtctggatttccagtggcgtaaaaacagccaatccggtaactggcaggcatatgacatgatcgccgaaggcgtcagcatgatcaccaccaaacagaacgagtggagcgatctgctgcgtactaaaggtattgatggcctgaccgcgcagttgcagtcgatctctcgtcagaagatcaccctgcaagagaacaaataatggcgcagcatctcagctggacacgtgacggcgagcgccttgcattacagggcgagcttgatcaggacgtgcttaacccgctctgggatgcgcgagctgaggcgctgcagggcgtgagcgtcatcgatctcaccgcgcttacgcgggtggataccgctggcgtcgccctgctggtgcacttcatcgccctggtcaaaaaacagggcagggcggtgaaactggaaggcgtcagcgataacgtcctgacattagcgcaactttataatttgcctgccgacgccctgcctcactaatattttcagtacgttactacccgtagcctcgcgagattttttagcgaggctttttgcttatttaagacagcgccactttcctctaagatgttggactgttttcattctcggacaatagtagatcccatggaaaatcatgaaattcagagcgtgctgatcaatgcactctcactccaggaagcccacgtcaccggcgatggcagtcactttcaggttattgctgtgggtgaaatttttgacggcatgagccgggtcaagaagcagcaagctgtttatggcccgctgatggaatacattgcggacaaccgcatccatgccgtctcgatcaaagcgtataccccggctgaatgggcgcgcgatcgtaaacttaacggtttttgagctgccggttacgcaccgtcagcatttgtgaattcttaacagagaacagatgaatggataagtttcgtgtacaggggccaacgcggcttcagggcgaagtgacaatttccggcgcgaaaaacgcggccctgccaattcttttcgccgctttgctggccgaagagcctgttgaaatccgtaacgttccgaaactgaaagatattgataccaccatgaagctgctcagccagctgggcatgaaagtggatcgcaacggctccgtgtggatcgatgcccgtgacgtcaatatcttctgcgcgccttacgatctggtgaaaaccatgcgcgcttctatctgggcgcttggcccgctggtggcgcgttttggtcagggtcaggtttccctgccgggcggctgtgcgattggcgcgcgcccggttgacctgcacatcagcggccttgagcagctgggcgcgcagatcaaactggaagaaggttacgttaaagcgtctgtggatggccgcctgaagggtgcgcatatcgtgatggacaaggtcagcgttggtgcgaccgtcaccatcatgtccgccgctaccctggcagaaggcaccaccattatcgaaaacgcggcccgtgagccggagatcgtcgatacggcgaacttcctcaatacgctgggcgcgaagatcaccggcatgggtaccgacaagatcaccatcgaaggcgttgaacgtcttggcggcggcgtctacagcgtgctgcctgaccgtatcgaaaccggtactttcctggtggcggcagccatttccggcggcaaaattgtttgtcataaagcgcagccggatacgctggatgcggtactggcgaaactgcgtgaagcgggtgccgatatcgaagtgggcgaagactggatcagcctcgacatgcacggcaaacgtccgaaagcggttaacgtgcgtaccgcgccgcacccggctttcccgactgacatgcaggcgcagttcacgctgctgaacctggtggcggaagggacgggcgtgatcatcgaaacgatcttcgaaaaccgtttcatgcacattcctgagctgatccgtatgggcgcgcacgccgagatcgaaagcaacaccgcgatctgccatggtgtggaaaccctgtcgggcgcgcaggtgatggcgaccgatttgcgtgcgtccgcaagcctggtactggcgggttgtatcgcagagggcaccaccatcgtcgaccgtatttatcatatcgaccgtggttacgagcgtattgaagacaaactgcgtgcgctcggtgcgaacattgagcgcataaaaggcgaataagctaagcggtaatgcaaccccctgtacgcagggggttgttgcattgtagatggcgtacagccgctatttatgcttctgctggcgcatcatgctggtgcgatcgataaactcatgggtgaccggatcgtggtaacgcgacggccagataatccagggatccgtgtccagcgccttcgcaatgatccattcccctttcggccatgagcgcgtcagcgcatttgccagcgtcgatgaacttagcccgttccggcgcgactccgcggccagcgacgtccctttcttacgcaatccggcgatgatatcggcaggatgccagtcgataaatttattttccatcactcctccctgcggttgaattatgtgcggcttatcctgatgcgccgcagcaattcactatactccttgcgacgtgttgttctaaaaagttcatgtaaacgaaagtgcaattcagaatttattaaggtcgaaatagcaggatataagcgcttatcgggaaggtagtgaaaacttataagaacttattagaatctttccgcgcatgacgcggaaagatatcggcaggattaacgatcgcgctgaacggcgatgtgggcgaggccaataagcgcatcgcgccacggcgtatcaggcagtacctgcaaggcatgaatggccttgtcggcttcttcttcggcgcgacgacgcgtccattccagcgaaccgcaatcggccatggcttccagaaccggctctaaaagatgccgtccgttgccctgttcgatggcctcgcggatcatctgcgcctgttgcggcgtaccgttacgcattgcgtgcaacagcggcagggtcggtttaccttcgttgagatcgtcgccgacgtttttgcctaaggtttccccgtcggcgctgtaatcaagcagatcgtcaatgagctggaacgcggtgcccagatagcggccgtaatcctgaagccctttttcctgcgcggcgctgcagtccgcgagaatgccggagcactgcgcggccgcttcaaacaggcgcgcggttttgctgtaaatcacccgcatgtagttttcttcggtgatgttcggatcgttaacgttcatcagttgcagcacttcgccttcggcaatgacgtttaccgcttccgacattacctccagcaccttcagcgagcctaagctggtcatcatctggaaggagcgcgtatagataaaatcgcccaccagcacgctggcagcattgccaaaagccgcgttagccgtggctttgccgcggcgcatatctgactcgtctaccacgtcatcatgcagcagcgtggcagtgtggataaattcgattaatgctgcgagggtgatgtgcgcatttccgtcatagccaatagcccgtgcggcaagcaccgcgatcatcggacggatgcgtttaccgccgccgctgacgatgtagtaacccaactggttaatcaactggacatcggagttgagctgttgaaggatagtcgcattcacacccgccatatcttgcgcggttaactcattgattttttctaaattcatcgctaatgccgggcttaaagtcctgtttaccacatatcaaaatgggataacgaagggttacgggttagaatagtatcgtcgattgtactgaaaaaacccgccagataaacgttaccatacacgttgtgttttttttcttcgcggattgatgatcactcttgtcaaagcttcgcgttttgcgtaatattcgcgccctattgtgaatatttatagcgcactctgaatcacacaaaaggtgcgcggaagcggagttttttatgtacgcggttttccaaagtggtggtaaacaacaccgagtaagcgaaggtcagaccattcgcctggaaaagctggacatcgcaactggcgaaactatcgagttcgctgaagttctgatgatcgcaaacggtgaagaagtcaaaatcggcgttcctttcgttgatggcggcgttatcaaagctgaaatcgttgctcacggtcgtggcgagaaaattaagattgttaagtttcgtcgtcgtaaacactaccgtaagcagcaaggccatcgtcagtggttcactgatgttaaaatcactggcatcagcgcttaagactaggggagcagatttaaatggcacacaaaaaggctggcggctcaactcgtaacggtcgcgattcagaagctaaacgtctgggcgtaaaacgctttggcggagaagcagtactggcaggtagcatcatcgttcgtcaacgtggtactaaattccacgctggcagcaacgttggttgtggccgtgaccacactctgttcgctttgactgacggtaaagttaagttcgaagttaaaggcccgaaaaaccgtaagttcatcagcatcgttgctgaataagtttttcgcgtcccggtaacggatgaaagccccgcaacacgttgcggggctttttacattcgacgtccggaaaaatctcttgtagggaaaacgggcaatgaagcagcaggcaggcattggaattcttttggcgctgacgacagccatgtgctggggtgcattgccaatcgcaatgaagcaggtgctggaagtgatggaaccaccaactatcgtgttctatcgctttttaatggcagctattggtcttggcctgattctggccgttaaaggcaaactgccgccgatgcgcatttttcggcagccccgctggttggtgctgcttgccattgctaccgggggcttattcgggaatttcattctcttcagctcttctctacaatatttgaccccaacggcatcacaggtgattggacagctctcaccggtgggcatgatggtcgccagcgtgttcattcttaaagagaagatgcgcggcacacagatcataggggcgataatgctgctttgcggactggtgatgtttttcaacaccagcctggtggagatcttcacccgcctgaccgattacacctggggtgtgatcttcggcgtgggagcggcaacggtctgggtaagctatggcgtcgcgcaaaaagtattattgcgtcgtctggcctcacagcagatcctctttttgctgtacactttatgtacaatagccttgttgccgctggcgaaaccggccatgatcgccgaactcagccaatggcaactggcgtgcctggtgttttgcgggctgaatacgctggtcggttatggcgcgctggcggaagccatggcgcgctggcaggcggcgcaggtgagcgcgttaatcacgttgacgccgctgtttacactgttgttttcagatttattatcacaggcctggcccgatgtcttcgccagaccgatgttaaaccttttaggttatctcggtgcgtttgtcgtggttgcgggcgcgatgtattccgccataggccatcgcctgtggggacgtctgcgcaagcgtgaagtggttgtcactttaccccgctcaggcgaatgagtaacggagagtaaaatgaagtttgttgatgaagcgacgatcctggtcgtggcaggtgatggcggtaacggttgtgtaagcttccgccgtgaaaaatatattccccgtggcggccctgacggcggcgacggtggtgacggtggcgatgtctggctggaagcggacgaaaacctgaatacccttatcgattaccgctttgaaaaatctttccgcgctgagcgtggtcagaatggtcaaagccgtgactgtaccggtaagcgcggtaaagacacctgcgttaaggtgccgatcggtacgcgtgttatcgatcagggcaccggcgaaaccatgggcgacatgaccaaacacggtcagcgtctgatggtggctaaaggcggctggcacgggctgggtaacacccgtttcaaatcgtccgtcaaccgtacgccgcgtcagaagaccatgggtacgcctggcgaaaagcgtgacattcagctggagctgatgctgctggctgacgtggggatgctggggatgccgaacgccggtaaatccacctttatccgcgctgtctctgcggcgaagccgaaagtcgcggattatccgtttaccaccctggtgccaagccttggcgtggtgcgtatggataacgagaagagctttgtggtggcagacatccctggccttatcgaaggggcggcggaaggcgccggtctgggtattcgcttcctgaaacaccttgagcgttgccgcgtactgcttcacctcatcgacatcgatccgatcgatggttccgatccggcggaaaacgcgcgcatcatcactggcgagctggaaaaatacagtgaaaatctggccagtaagccgcgctggctggtctttaacaagatcgacatgatggacaaagcgcaggccgaagaaaaagcgaaagctatcgccgaagctctgggctgggaagataagtattacctgatttccgccgccacccagcagggcgttaaagacctgtgctgggatgtgatgaccttcatcatcgagaacccaatcgttcacgctgaagaagagaagcagccagagaaagtcgaattcatgtgggatgattatcatcgccagcagctggaagaagcggaagctgaagaagacgacgaagactgggatgacgactgggatgaagaagacgacgaaggcgttgagttcatctacaagcgttaatccagactaacgctctgccagccaaaagcccggtacgcataacgcgaccgggctttttgtttagttgttctggtaaatatctttgtacagacggctttcaaaccgcaccagcggaatgcggcggttacgctgatcggcaggctcaacggcatagccggacagatactgcacgaacgccatccgctgaccgctggcggtggtaataaagcccgccagattgtagacgccctgcagagagccggtcttcgccgatactttaccatccacgcctgcggcatgcagacccgcgcggtactgcaacgagccgtcgtagcccgccagcggcagcatcgagataaagttaagttcggtatcatgctgagcaatatattgcagcacctgcatcatggtggccggagatatcaggttgtgacgcgacaggccagagccatccaccacaatgctgttccccaaatcgacgcccgcctgctggcggaggatctgccgtaccgcgtcagcgccggcgcgccaggtgccgggcacgccaaagcgcgcatggccgatagtgcggaacaccgtgtcggcgatcatattgtcggattttttcagcatgatcttcagcagatcgtgcaggggagccgactgcttgctggcgatcaccgtgcccggttcattgaccagcgtctgacgcagcagggtgccgctataggtgatccccgcctgtttcagttcatctttgataatggcgccggcatagcttgcgccgtcctgaatggcgaacgccagcggcagggggtcagcacgctgcgtcatacagcctgtcagcgtgaaacggtttaagtcacccggaaccacatccagctcgcagtactggccctcagcgctgccacgggccagcgtacgcacctggctgaacatgttcacggggtaataggaggcgacgcggataaatgccagatcattggctttctgagcgctgtagagggaaaccgagaaacagttacggtcgacaatggcggccgctggcggggcactgaagcattgcgtcatgtcattccatggccagccgggcgctttgtcatgactggcgaaaatggaggtatcgataagcacgttgcccgcgatttcacgcacgcctgcttttttcagaaccgccaccatattgcgaatatcctgacgttttaacgtcggatcgcccccaaagcgcgccgtcagatcgccttgtaagacgccgttttcaatcggggctttgctttcaagcgtggtcgtgaagcggtaatcagggccaagttgcagcagagcggcaagggcggtgatcactttctgcgtactggcgggaagggccatttgctggctgtgataatcaatatccggtgcctgagcgccaatcttctgcaccatcagggcgaggttcgcgccggcaggcaactgattgatgtactcgtcgacattcgccgcctgaacattcatcgctatactggtggtcaatccgatgacaaatctggaaaatcgcataatctcgcgctaacaacctggaaacaggccgtcatactacggtgcatcgcccttgaaagtaaacgatgacccatagtgaacttcgcggtaaaatgcgtatcaaattgaaaaattgcttctgacctggggctgtgactccgggtcagttttcttttgcttctggtccgggaacccgatgaaaaacgggcgggcttagctgccggggcgggacaccgctccctacaggaatgttcaagaggtataacaaatgcaagctattccgatgaccttacgcggtgccgaaaaactgcgcgaagagctggattttctcaagtccgtacgccgtcctgaaattatcgcggccatcgccgatgcccgtgaacatggcgatctgaaagaaaacgccgagtaccatgccgcccgtgaacagcagggcttctgcgaaggccgtatcgctgatatcgaagcgaagctgtccaacgcgcaggtgatcgacattgctaaaatcccgaacaacgggcgtgtgatttttggctgtacggtaaccgtgctgaacctcgacaacgacgaagagcagacctaccgcatcgtgggcgatgacgaggctgattttaagcagaatctgatttctgtgaattcgcctatcgcccgtggcctggtgggtaaagagcaggacgatgtcgtggtcatcaagacgccgggcggcgaagttgaattcgaaatcatcaaagtggaatatctttgattaggttacaatgtgtaatatgttgacgcattgtaaagaaaagaaaaaggccgcgaagcggccttttaacaacactcagagcgtggcattttgctcgtctgcttttagaaaacccctcgttttacacagattttgtgtttaactcaggatattcttaacgtggcagcgcgattttacggtctgctgttgggcgatacagaaccagcgttttaccgatgacctgtacattacaggcgccggtttcacgaacaatggcttccacgatcaacgtcttggtttcgcggtcttcagtcgcgattttaaccttgataagctcatggtgttgtaacgcatgttcaatctcggccagtaccccttcggtcagaccattgttgccaagctgtactactggcttgagcggatgtgccagacctttcaggtgctgtttttgtttagtactcagattcatcgtatatttttgcttacgttgggattgaaaacggttcattctaccgccatctcccttatatcgccaaattgccgtgtggaaatttacaccatcggctcacgatgaacccagatggaatgttaaatgacaggtaaaaagcgttctgccagctccagtcgctggcttcaggaacactttagcgataaatatgttcaagcggcacagaaaaaagggttacgttcccgtgcctggtttaaacttgatgaaatacagcaaagtgacaaactttttaagccggggatgacagttgttgaccttggcgcagcacctggcggctggtcacagtatgtggtaacacagattggtggcaaaggccgtatcatcgcatgtgatcttttacctatggatcctatcgttggtgtggacttccttcagggcgattttcgtgatgaattagtcgtgaaagcgttacttgatagggtaggcgacagtaaagtccaggtcgtaatgtcagatatggcaccgaacatgagcggaacacccgcggtggatattccccgcgccatgtatttggtggagctggcattgcagatgtgtcgggacgtattggcacctggcggcagttttgtagtgaaggtgtttcagggcgaaggcttcgatgagtatctaagggaaattcgctccctgtttacgaaggttaaagttcgtaagccggactcttctcgtgcgcgttcacgtgaagtgtacattgtagcgaccgggcgaaaatcataacccgttgatttcagacaaccgtttgaatgaggctggatatggcgtatcctgacgctgtttttaacacagttgtaatatgaggttaatcccttgagtgacatggcgaaaaacctaatactctggctggtcattgccgtcgtgctgatgtcagtattccagagctttgggcccagcgagtctaatggccgtaaggtggattactctaccttcctgcaagaggtcaatcaggaccaggttcgcgaagcgcgtatcaacggacgtgagatcaacgttaccaagaaagatagtaaccgttacacgacttacatcccggtaaacgacccgaaactgcttgataacctgctgacgaaaaacgtcaaagtggttggcgagccgccggaagaaccgagcctgctggcttctatctttatttcctggttcccgatgctgttgctgattggggtctggatattctttatgcgtcagatgcagggcggcggtggcaaaggcgccatgtcgttcggcaagagcaaggcgcgtatgctcactgaagatcagattaaaaccacgtttgctgatgtcgcaggttgcgatgaagcgaaagaagaagtggcggaactggttgagtacctgcgtgaaccgagccgtttccagaaactgggcggtaaaattccaaaaggcgtgctgatggtggggccgccgggtaccggtaaaacgctgctggcgaaagctatcgccggtgaagcgaaagtgccgttctttacgatttccggttcggacttcgtggaaatgttcgttggtgtcggtgcctctcgtgtgcgtgacatgttcgaacaggccaaaaaagctgcaccgtgcatcatctttatcgatgaaatcgacgccgtaggccgtcagcgtggcgcaggtctgggtggtggtcacgacgaacgtgagcagaccctgaaccagatgctggttgagatggatggcttcgaaggtaacgaaggcattatcgttatcgccgcgactaaccgtccggacgtgcttgacccggcgctgctgcgtccaggccgtttcgaccgtcaggttgtggtcggtctgccggatgtacgtggtcgtgagcagatcctgaaagtgcatatgcgtcgcgtaccgctgtcaccggatattgacgcggcaatcattgcccgcggcacgcctggcttctcgggcgcggatctggcgaacctggtgaacgaagcggcactgtttgctgcccgtggtaacaaacgcgtcgtgtcgatggtggaattcgagaaagcgaaagacaaaatcatgatgggtgcggaacgtcgctctatggtgatgacggaagcgcaaaaagaatccacggcgtatcacgaagcaggccatgcgatcatcggacgtctggtgccggaacacgatccggtgcataaagtgacgatcatcccgcgcggccgtgcgctgggcgtgaccttcttcctgcctgaaggtgacgcgatcagcgccagccgtcagaagctggaaagccagatttcgacgctgtacggcggtcgtctggcagaagaaatcatctacggtgcggagcatgtttccaccggtgcgtcgaacgacattaaagtcgcgactaacctggcgcgtaacatggtcacccagtggggcttctccgataaactcggtccgctgctgtacgcagaagaagaaggcgaagtgttccttggccgttctgtcgcaaaagcgaagcatatgtctgatgaaacggcacgtatcatcgaccaggaagtcaaagcgctgattgagcgtaactacaatcgcgcccgtgagatcctgaatgcgaatatggatattctgcatgcgatgaaagatgcgctcatgaaatatgagaccatcgacgcaccgcagatcgatgacctgatggctcgccgcgatgtgcgtccgccagcgggttgggaagatccaggcgcgtccaacaactctgacaacaacggcaccccgcgtgcgccgcgtccggtcgatgaaccgcgtacgccgaatccgggcaataccatgtcagagcagctgggcgacaaataagtttttcgcactgatgctgtgtctgtattacttcaaaccctggagcttgctccggggttttttattattctgttcacctcgttatacaagggatgatttatgaaacgctttgctcaggggtcagtgctcgacctgtcgcatccacatgttatgggcattctgaacgttaccccggattccttttctgacggtggcgcgcataacacgctgatcgaggcagtaaagcacgctaacctgatgatcaatgcgggggcgaccattatcgacgtcggcggcgaatcgacgcgtccgggggcgctggatgtcagcgtagatgaagagttgtcccgcgtggtgccggtggttgaagcgctggcgcagcgttttgaagtgtggatctcggttgatacctcaaagccggaagtgatccgcgaaatcgcccgcgtcggcgcgcatcttatcaatgacatccgttccctgacggagccgggggcgctggaggcggcggcggaaaccgggctgccggtctgtctgatgcatatgcagggcgaccccaaaaccatgcaggatgcgccaaaatacgatgatgttattactgacgtaacgcgcttttttatcgacaatattgcacgttgcgaacaggcgggcatcgcaaaagagaaattgttgctcgacccgggattcggtttcggtaagaatctgtcccacaactatgcgctgctcgcccgcttatctgaattccatcagtttgatctaccgttgctggtgggaatgtcgcgcaaatcgatgattggccagctactgaatgtagggccttctgaacgcctcagcggcagcctggcgtgcgcggtgatcgcggcaatgcagggcgcgcatattattcgtgtccatgacgtaaaagaaacggtagaggctatgcgagtggtcgaagccacactgtcagcgaagggaaagaaacgctatgagtgaacgtaaatattttggaacagatggtattcgtggtcgtgtaggcgatgcgccaattacgccggatttcgttcttaaactcggctgggccgccggtaaagtcctggcgcgccatggctcgcgtaaaatcattatcggtaaagatacgcgcatttccggctacatgctggaatctgcgctggaagccgggctatcagcggcgggcatttccgcctcttttaccggaccaatgccgacgcctgctgtcgcgtacctgacgcggaccttccgcgcggaagcgggaattgtgatttccgcctcccataacccgttctacgataacggtattaaattcttctccatcgacggcaccaaactgccggatgacgtggaagaggcgattgaagccgaactggaaaaagagatcacctgcgtggattcggcgctgctgggtaaagccagccgtatcgtcgatgccgccgggcgttacattgaattctgcaaaggcaccttcccgaacgaactcagccttaagggtttgaaaattgtggttgactgcgcgcacggcgcaacctaccacatcgcgccaaacgtcttccgcgagctgggcgctcacgtcatcaccattggctgtgagccgaacggcgtgaacatcaacgaggaagtaggggcaacggacgttcgtacgttgcaggcccgcgtggtggccgaaaaagccgatatcggtatcgccttcgacggtgacggtgaccgcgtgatcatggtggatcatgaaggtaacaaggttgatggcgatcagatcctctatatcatcgcccgtgaaggtcttcgtcagggtcagctgcgcggtggcgcagtcggcacgctgatgagcaatatggggctggagctggcgctgaaacagctcggcattccgtttgcgcgcgcaaaagtgggcgaccgctacgtgctggaaaaacttcaggagaaaggctggcgcattggtgcggaaaactccggccatattctgctgctggacaaaaccactaccggcgacggtatcgtggctggccttcaggttgtggcggcgatggtgcgtaaccatatgaccctgcacgacctgtgcagcggtatgaagctgttcccgcaaatcctcattaacgtacgctttacggctggcaacggcgatccgctggaagatgaaaccgtgaaagcggtcaccgcagaagtggaagcggcgctgggcaatcgcggccgcgtgttgctgcgtaaatccggtaccgagccgttgatccgtgtgatggtggaaggcgaagacgaagcgcaggttacggcattcgctaaccgcattgcggacgcagtgaaagcggtataattaccgtgttaagtgcctaaaaaaggcggcacttgccgcctttaaatcgcacaggcttcgcgtttttgctgtttttttccgcacttgatacaatgcgttgaaattgcccttgcgcaggtcatgcgctttggttagtattcacacccgcttcagtgggaaacgaaataacgtcccgcttttatggtcagaagctaatgttacgcggcagccccgcaaggaacaggttgattatgtacgaagctcttttggtagttttccttattgtggcgattggccttgtcggtctgattatgctgcaacaaggtaaaggcgctgatatgggagcctcctttggcgcaggctcatctgctacgctgttcggttcaagtggttctggtaacttcatgacccgcatgacagctgtactgggtaccctgttcttcatcatcagcctggtgttgggtaacattaacagcaacaaaaccagtaaaggaagcgagtgggaaaatctgagcgcgccagcgaaatctgagcaaactcagccagctgctccggctaagccgaccagcgatatcccgcagtaatagcagtatcagtgctgaggtggtggaattggtagacacgctaccttgaggtggtagtgccctaacgggcttgtgggttcgagtcccatcctcagtaccaatattccgaaagaaagacatcgaaagatgtcttttttttcgtctgtaatttacctggcagacaccgacaaacaaaaaaagggcgcttatcgcgccctttgttctcactgaaaaggttatttcttctcgctgtgttccaggctgtccatctgcggcaggcccgtactggcggaggcggtaagcaggccagactgcgcataaccaaacagcttctcgcgggtatcggcgatatccagattacgcatggtcagctgcccgatacggtcgtcaggtgagaatacggaatcccctttttccatggtcagacgctctgctttataggtcaggttgtcagacacagtattcaggatcgagtagtcattgccgcgacgcagttcaagcgtcacttcgccggtaatagcgcttgccacccagcgttgcagcgcgtcacgcagcatcagcgcctgagagtcaaaccagcggccctgatacagcagacgacccagctgacggccatgggcgtgatactgctcaatggtatcttcgttatgaataccggtcagcaaacgctcataggcaatgtgcagcaaggccatgcccggggcttcgtaaatgccacggcttttcgcttcaatgatacggttttcaatctgatcgctcatccccagaccgtgacggccgccgatacggttcgcttccagcatcagttccacatcatcgctgaaggtctggccgttgagcgcaacagggtggccctgttcaaaacggatggtgacttcttccgccgggatcttaacgttctcatcccagaattttacgcccatgatcgggttaacgattttcacgctggagttcaggaattccagatccttcgcttcgtgcgttgcgcccagcatattggaatcggtggagtaggctttttccacggacattttgtaatcgaatccgcaggcgatcatgaattcggacatttcctgacggccgcccagctcatcaataaagtcggtatccagccacggtttatagattttcagctcagcgttagtcagcagaccgtagcggtagaaacgttcgatatcgttgcctttataggtactgccgtcgccccagatattcacaccgtcttctttcatggcggcgaccagcatggttccggtcacagcacggcccagcggcgtggtgttgaagtaggtcaacccaccggtggtgttatgaaacgcgccacactggatagcggcaatgccttcggcgaccagctgcttacggcagtcgatcaggcgggcattctcggcaccatactcttttgcacggcgtggaatcgcgtcatagtcatcctcgtccggttgacccaagtttgctgtataggcgtaaggaacggcacctttctggcgcatccacagcagggccgcgctggtgtcgagaccaccggagaatgcaataccaatacgttgtccaaccggaagatgcttgagaatcgtcgtcataaaataaatccctgcttaatatactgatggtgagagacttaacagccacgccatgatgtgttgtcaccggaagatgataccgcttagcttctcatcattaatgcatttttatgcaaaattagtgagttttcatttaaacatcttttggcgacgatcgaaagcgaagagtgacagaatagttaaaaaatcgctggcgtagccgccgggcgggcgtttaacgatgtgtctttcgcgtcaatacctgcttcattgcgtattccacgctatgcaaatctgtgcgtggcggcaggtaaacccctctgcctggcgttcattctgcggtttccggcacgcgcgcgtagttttccttgcaatgaacaaaatcaattgattataatactcgtcttatcagtagttcccggtgtttacacctgtcttaacttgcatttaatgcatgatcggcgtagtatttgccacgtttcaggcgcggggtggagcagcctggtagctcgtcgggctcataacccgaaggtcgtcggttcaaatccggcccccgcaaccactttcccttagtgttctttttcaaatatactgtgaagacgtttgagccttcctctttttggatttgaaaaaaatacttctggaaggttctccaggccgcagttgcggctatagggttcagttatctaaagccccgatttatcggggttttttgttatctgactacagaataactgggcttagcgccctttttttatgtcttgggggtgggtttgtccacattagagcaaaaattaacagagatgatcactgcaccggttgaggctctgggctatgaactggtcggcatcgaatttgtacgcggtcgcacatctacgctgcgcatctatattgatagtgataatggcatcaatgttgatgattgtgctgatgtcagccaccaggtgagcgcagtaatggacgttgaagatcctattaccgtcgcttacaacctggaagtctcctcaccgggtctcgatcgtcctttattcaccgccgagcactacgcgcgttatatcggcgaagaagcaacgctggtactgcgtatggcggtacaaaaccgtcgcaagtggcagggtgtaattaagggtgttgacggtgaaatgatcaccgttacggtcgacggtaaagatgaagtgttcgctttaagcaatatccagaaagcgaacctggtcccccacttttaacagtctggattgaggtgaaaggcccccaatgaacaaagaaattttggctgttgttgaagcagtttccaacgaaaaatcgttgccgcgtgagaaaatttttgaagcgctggaaagtgctctggcgacagcaaccaagaaaaaatacgagcaagagatcgacgttcgcgtagaaatcgatcgcaaaagcggcgacttcgacaccttccgtcgctgggttatcgttgaagaagtgacgcagccgacccgtgaaatcacgctggaagctgcacgttacgaagatgaaagcctgaatgtgggtgattacgttgaagaccagattgaatctgtcacctttgaccgcattactacacaaacagcgaaacaggttatcgtacagaaagtacgtgaagctgaacgcgcgatggttgtggatcagttccgcgagcacgaaggtgagatcatcaccggcgtggtgaaaaaagtgaaccgtgacaacatctctctggatctgggcagcaatgctgaagctgtgatcctgcgtgaagatatgctgccgcgtgaaaacttccgtccaggcgaccgtattcgtggcgtgctttatgccgtgcgtccggaagcgcgtggtgcgcagctgttcgtgacgcgttccaaaccggaaatgctgattgaactgttccgcattgaagtgccagaaattggcgaagaagttattgaaatcaaagccgctgctcgcgatccaggttctcgtgcgaaaatcgctgtgaaaaccaacgacaagcgtatcgatccggtaggtgcctgcgtaggtatgcgcggtgcccgtgtccaggcggtgtctaccgaactgggcggtgagcgtatcgatatcgtgctgtgggatgataatccggcgcagttcgttatcaacgcgatggcgccggcggatgtcgcctccatcgtggtggacgaagataagcacaccatggatatcgcggtagaagcgggtaacctggcgcaggcgattggccgtaatggtcagaacgtgcgccttgcttctcaactgagcggctgggaactcaacgtcatgaccgttgatgatcttcagtctaagcatcaggcggaagcccatgcagcgatcgacacctttactaagtatctcgacattgacgaagattttgccactgtactggtagaagaaggtttctcgacgctggaagaactggcctatgtgccaatgaaagagctgctggaaattgacggtcttgatgaagcgaccgtcgaagccttgcgcgatcgcgctaagaacgcactgaccaccctggcgctggcacaggaagaaagcctcggtaataataaaccggctgatgacctgctgagccttgaagggttggatcgcgaaatggcgtttaaactggctgctcgtggtgtttgtacgctggaagacctcgccgaccagggcatcgatgacctgagtgatattgaaggtctgaccgacgagaaagcgggcgagctgattatggccgcacgtaatatttgctggttcggtgacgaagcgtaataaactgtagcaggaaggaacagcatgacagatgtaaccgtaaaagcgctggccgctgagattcagacctccgtggaccgcctggtacagcaatttgctgatgcagggatcccgaagtcatctgacgactcagtgacagcacaagaaaaacagacattgttagcgcacctgaaccgtgaacatggttcagcgcctgacaagctgacgttgcagcgcaaaacgcgcagcacactgaacatccctggcaccggcggtaaaagcaaatcggtgcagatcgaagtccgcaaaaaacgcacctttgtaaaacgcgatccgcaagaggctgaacgtctcgccgcggaagaagaggcgaagcgcgaagcggaagagaaggccagtcgtgaagcgcaggaagctgctaagcgtgaagccgaggaaaaagccaagcgtgacgcacaagagaaagcgaaacgtgaagccgaagaaaaagcgaaacgcgaatccgctaacccggtgaaacgcgaagctgcggaaacgagcaaagtgagcaatcaacaatctgacgaaatgaccaggactgcccaggctgaaaaagcccgtcgtgaagccgaagcgcaagaactcaagcgcaaagctgaagaagaggcacgtcgtaaactggaagaagaagcacgccgcgtggcagaagatgcgcgtcgtatggccgaagaaaacgagaaaaatggtgttaatgtggctgctgaaccggttgaagagtccagtgactatcatgtaaccacttctcaacatgcgcgtcaggcagaagacgacagcgaccgcgaagtagaaggcggccgcagccgtacgcgtactgctaaagcacctcgcccgaaaaaaggcaacaagcattccgaatcgaaagccgatcgcgaagaagcgcgcgctgctgttcgtggcggtaaaggcggcaagcgtaaaggttcttctttacagcagggcttccagaaaccggctcaggcggttaaccgtgacgttatcatcggtgaaaccatcaccgtgggcgaactggctaacaaaatggcagtgaaaggctctcaggtcatcaaagcgatgatgaaactgggcgcaatggccaccatcaaccaggttatcgatcaggaaactgcgcagctggttgcggaagaaatgggccacaaagttatcctgcgtcgtgaaaacgagctggaagaggcggtaatgagcgaccgtgacactggcgctgcggcagaagctcgcgcacctgttgtgaccatcatgggtcacgttgaccacggtaaaacctcgctgctggactacattcgttcaacgaaagtggcctctggcgaagcgggcggcattactcagcacatcggtgcgtaccacgttgaaactgacaacggtatgatcaccttcctggataccccgggtcacgccgcctttacctccatgcgtgctcgtggtgcgcaggcaacggatatcgttgtgctggttgtggcagcggacgatggcgtgatgccgcagactatcgaagcaatccagcacgcgaaagcggcgcaggtgccggtagtggttgcggtgaacaaaattgataagccggaagctgacctggatcgcgttaaaaacgaactgtcccagtacggcgttatgccggaagagtggggcggcgagtctcagttcatccctgtatccgcgaaagccggtaccggtattgatgacctgctgaacgctatcctgctgcaggctgaagttctggaactgaaagcggttcgcaaaggtatggcgagcggcgcggttatcgaatccttcctggataaaggtcgtggtccggtagcaacggttctggtacgtgaaggtacgctgaacaaaggcgacatcgtgctttgtggcttcgaatatggccgtgttcgtgcaatgcgtaacgaactgggtcaggaagttatggaagccggtccgtctattccggttgaaatcctgggtctgtccggtgtgccggcagccggcgatgaagtgaccgttgtacgtgacgagaagaaagcgcgtgaagttgcactgtatcgtcagggcaaattccgtgaagtcaaactggcgcgtcagcagaaatccaaacttgagaacatgttcgctaacatgactgaaggcgaagttcacgaagtgaacgttgttctgaaagctgacgtacagggttctgtagaagcgatttccgattccttactgaaactgtctaccgacgaagtaaaagtaaggatcattggttccggcgtaggtggtatcaccgaaaccgacgcgaccctggctgcggcatccaatgctattctggttggcttcaacgttcgtgctgacgcctctgcgcgtaaagtgatcgaagcggaaagcctggatctgcgttactactccgtcatctaccacctgatcgacgaagtgaaagcagcgatgagcggcatgctgtctccggaactgaaacagcagatcatcggtctggctgaagtgcgtgacgtgttcaaatcaccgaaattcggtgcgatcgcgggctgtatggttaccgaaggcaccatcaaacgtcacaacccgatccgcgttctgcgtgacaacgtggttatctacgaaggcgagctggagtccctgcgccgcttcaaagatgacgttaacgaagttcgtaacggcatggaatgtggtatcggcgtgaagaactacaacgacgttcgcgttggcgatatgatcgaagtgttcgaaatcatcgagatcaagcgtaccatcgcttaatcttcgtaatgcccggtggctgggttgcaggtctgataagcgtagcgccttcaggcctgagagcaccacctggcaactatttcaaaaggggcttttagccccttttttgtctttatctggaggacttattatggcgaaagaatttggccgccctcagcgtgtcgcgcaggagatgcaaaaagagatcgcgcttatcctgcaacgcgaaattaaagatccacgtctgggcatgatgaccaccgtttccggtgtggaaatgtcccgcgacctggcctatgcgaaagtgtttgtgacctttctgaacgacaaagacgaagaagccattaaaggcggcatcaaagcattgcaggacgcctccgggtttatccgttcgctgctgggtaaagccatgcgtctgcgtatcgtgccggaactgaccttcttctacgacaactcgttggtggaaggtatgcgtatgtctaatctggtgaccaacgtggtgcgtcatgacgatgaacgtcgtgtgaacccggacgacaccaaggaggactgatgagtcgtcctcgtcgtcgcggtcgcgatgtgcacggcgtactgttgctggataagccgcaagggatgtccagcaacgacgtgctgcaaaaagtaaaacgtctctataacgcgaatcgcgccgggcatactggcgcgctggatccgctggcgaccggcatgctgccgatttgcctgggagaggcgacaaagttttcccagtatctgctggattcggataagcgttaccgcgtgattgctcgtctggggcagcgcacggatacctccgatgccgatggacagattgttgaagaacgcccgatcaccttcagcgcagagcagcttgctgccgccctggaaaccttccgcggtgatatccagcaaatcccgtccatgtattcggctctgaagtatcaggggaagaagctttacgagtacgcgcgccagggtattgatgtgccccgtgaggctcgtccgattaccgtttacgagctgctgtttatccgccacgaaggggatgagctggagctggaagtacactgctcgaaaggcacctatatccgcaccattgtggacgatctcggtgaaaagctcggctgcggcgcacatgtgattttcctgcgccgtctggcggtgagcaagtacccggttgatcgcatggtgacgcttgagcaattgcagtcgctggttgagcaggccggtgagcaggatattcctgccgctcagttgcttgatcctctgctgatgccaatggacagtccggcagcggacttcccggtcgtgaatattcctgccgtcagcgccgcctatttcaggaacggccagcccgttcgcgcggcacaagcgccgacagaaggcctggtgcgcgtgacggaagggccagagtcggtatttatcggcatggcagaaatcgacgatcagggccgcgtggcgccacgccgcctggtggttgagtacccggcgtaatccattgcagttaccttgcgataacagggtactgcgagtagaatattgccgcttaacgtcaggttagatgtttaacatcttccggcgttaaacctggggttgctgaattagagatcggcaccctttcattcttttaattttggagtttaaaatgtctctaagcgttgaagctaaagcaaaaatcgtttccgagtttggtcgtggcgagaacgacagcggttctaccgaagttcaggttgccctgctgactgctcagatcaaccacctgcagggtcactttgcagagcacaaaaaagatcaccacagccgtcgtggtctgctgcgcatggtttctcagcgtcgtaaactgctcgactacctgaaacgtaaagatgttgcacgctacaccgcgctgatcgagcgtctgggtctgcgtcgctaagtctggcgagtttcacagaaaggggccttaacggccccttttttcaaccagacggcagcaattcgacctaaactattgtattgttgctatgaatgatcttcgttgcagaggttcgcgcggctaatgagaggctttacccggtttgggttagggttgtcattagtcgcgaggatgcacagaagatcgggtattaacgtcagcacacccaatggtgtgctgtcattcattaagaaaggataaaattttgcttaatccgatcattcgtaaattccagtacggtcaacataccgtaacgctggagaccggcatgatggcgcgtcaggcaactgcagctgttatggtaagcatggacgacaccgcggtattcgttaccgttgtgggtcagaaaaaagcgaagccgggccaggacttcttcccgctgacggttaactatcaggagcgtacttatgctgctggtaaaatcccgggtggcttcttccgtcgtgaaggccgtccaagcgaaggcgaaacgctgatcgcgcgtctgattgaccgcccggttcgtccgctgttcccggaaggcttcgttaacgaagtacaggttatcgccaccgtagtttccgttaacccgcaggttaacccggacatcgtggcaatgatcggcgcatccgctgcgctgtctctgtccggtatcccgttcaacggcccaatcggcgcggcgcgtgtaggttacatcaatgaccagtacgtactgaacccgacccaggaagagctgaaagcaagcaaactggatctggtggttgccggtaccgaaggtgcagtgctgatggttgaatccgaagctgaactgctgagcgaagaccagatgctgggcgccgtggtatttggccacgaacagcagcagatcgtgatccagaacatcaacgacctggtgaaagaagccggtaaaccgcgttgggactggcagccagaagcggctaacgaagccctgaatgcacgtgttgctgcgctggctgaatcccgtctgagcgatgcttaccgcatcaccgacaaacaggagcgttacacgcaggttgatgctatcaaagctgaaactgtggctgcgctgctggctgaagatgaaaccctggacgccaacgaactgggcgacatcctgcacgctatcgagaaaaacgttgttcgtagccgcgtactggcaggcgagccgcgtattgatggccgtgaaaaagacatgatccgtggtctggacgtgcgtaccggcgtgctgccgcgtacccacggttccgcactcttcacccgtggcgaaactcaggcgctggttactgcgaccctgggcaccacccgtgacgcgcagaacatcgacgaactgatgggcgagcgcactgacagcttcctgttccactataacttccctccgtactccgttggcgagacgggcatggtaggttcaccgaagcgtcgtgaaatcggtcacggtcgtctggcgaagcgtggcgtgctggcagtaatgcctgacgctgagaaattcccgtacaccgtacgtgtggtttctgaaatcaccgaatccaacggttcttcttccatggcgtccgtatgcggtgcttctctggcgctgatggatgcgggtgtgccgatcaaagccgccgttgcgggtatcgcaatgggtctggtgaaagaaggcgacaacttcgttgtgctgtctgacatcctcggcgacgaagaccacctgggcgatatggacttcaaagtagcgggttcccgcgacggtatctctgcgctgcagatggatatcaaaattgaaggtatcaccaaagagatcatgcaggttgcgctgaaccaggctaaaggtgcgcgtctgcacattctgggcgtgatggaacaggcaatcaacgcgccgcgtggcgatatttcacagttcgcgccgcgtattcacaccatcaagatcaatccggacaagatcaaagacgtcatcggtaaaggtggctctgtgatccgtgcgctgaccgaagaaaccggcaccaccatcgaaatcgaagatgacggcaccgtgaaaatcgcagcgaccgacggcgagaaagcgaaatacgctatccgtcgtatcgaagagatcaccgcagaaatcgaagtgggtcgcgtctacaatggtaaagtgacccgtatcgttgactttggcgcgttcgttgccatcggcggcggtaaagaaggtctggtgcacatttctcagatcgctgacaagcgtgtagagaaagtgaccgactatctgcagatgggtcaggaagtcccggttaaagttctggaagtcgatcgccagggccgcgtccgtctgagcattaaagaagcgactgaacaatctcagcctgctgaagcggcacaagcgccggcagcagaacaaggcgagtaaggttgctgtttagctctccgtcgttgacggagagttttcattccgggcaggatgctgtgtttgcagccgggggacaggatgtccatctaattgttgtcttcgggagtgggaaatgaagccttttttgcgctggtgtttcgttgcgacagctttaacgctggcaggatgcagcaactctgcctggcgtaagagcgaagtcctggcggtgccattgcaaccgactttgcagcaagaagtgattctggcgcgcatggaacaaattcttgccagtcgggctttaaccgatgatgaacgcgcacagcttttatatgagcgcggagtgttgtatgatagtctcggtctgagggcactggcgcgaaatgatttttcacaagcactggccatccgacccgatatgcctgaagtattcaattacttaggcatttacttaacgcaagcgggcaattttgacgccgcttatgaagcgtttgattctgtacttgagcttgatccaacttacaactacgcgcacttgaatcgcggtatcgctctgtattacggcggtcgtgacaagttagcgcaagatgatctgctggcgttttatcaagacgatcccaatgatcctttccgtagcctgtggctttacatcgccgagcgtaagcttgacgaaaagcaggccaaagaagcactaagacagcgcttcgagaaatcggatagagagcaatggggatggaacattgtcgagttctacctcggtgacattaacgaagcaacgttaatggatcgcctgaaggcggacgcaacggataacacctcgctcgctgagcatctcagtgaaaccaacttctatttaggtaagttctacctaagtctgggggaaaaggacagcgctacggcactgttcaagttagcggtcgctaacaacgtacacaactacgttgagcatcgttatgcattgttggaattatcgctcttgggccaggagcaagatgacctggcagaatcggaccagcaatagctgacgaacaacgatcagcccaccaacttttttagtaaagtcatcatcctgacgggtgagggcgtttttgttcgttaatcaactaaatttgagccggttcacacttttcaatgaaaattgcagatcaatttcacgatgagttacgtagactggccgccatcaatgaggcacatgtactacatgactgataccatcgaaaccactttttctgatcttgggctgaatgcctccatccttcaggccctgaacgatctgggttacgaaaagccatctccaatccaggcagagtgtatcccacatctgctgggtggccgcgatgttctgggtatggcccagaccggtagcggcaaaaccgcagcgttctctttaccgctgctgcacaacctcgatcctgagctgaaagcgccacagattctggtgctggccccgacccgcgaactggcggttcaggttgctgaagccatgacggacttctctaaacatatgcacggcgtaaacgtggttgccctttacggcggccagcgttatgacgtgcagctgcgcgccctgcgtcagggcccacaaattgttgtgggtaccccgggtcgcctgctcgatcacttaaaacgcggtacgctgaacctgtccaacctgaaaggtctggtactggacgaagcggatgaaatgctgcgtatgggcttcatcgaagacgttgaaaccatcatggctgagatcccggctgaacatcagaccgcgctgttctccgccaccatgccggaagcgatccgtcgcattacccgccgctttatgaaagagccgcaggaagtgcgcattcagtccagcgtaaccactcgcccggacatcagccagagctactggtctgtatacggtatgcgtaaaaacgaagcgctggtgcgtttcctggaagcagaagactttgacgcggcgatcatcttcgtgcgtaccaaaaatgcgaccctggaagtggctgaagcgctggagcgcagcggttataacagcgccgcgctgaacggtgacatgaaccaggcgctgcgtgagcagaccctggagcgtctgaaagatggtcgtctggacatcctgattgcgaccgacgttgcggcccgtggcctggacgttgagcgtatcagcctggttgttaactacgacatcccgatggactccgagtcttacgtgcaccgtatcggccgtaccggtcgtgcaggtcgtgcaggtcgcgcactgctgttcgttgagaaccgcgagcgtcgtctgctgcgtaacatcgaacgcaccatgaagctgaccattccggaagttgaactgccgaacgcagaactgctgggcaaacgccgtctggaaaaattcgccgctaaagttcagcagcagctggaaagcagcgatctggatctctaccgtggtctgctggcgaaaatccagccttccgctgacgaagagctggatatcgaaaccctggctgccgcactgctgaaaatggcacagggcgagcgtccgctgatcctgcctccagatgcgcctatgcgtccgaagcgtgaattccgtgagcgtgacgagcgtttcgaacgccgtggcgaccgtaatgaccgtggtccgcgtcctgagcgtggcggtgaagatcgtccgcgtcgtgaacgtcgtgacgcaggcgaaatggaactgtatcgcattgaagtgggccgtgatgatggtgttgaagttcgtcacatcgttggcgcgatcgctaacgaaggcgacatcagcagccgttacatcggtaatatcaagctgttcggtactcactccaccatcgagctgccgaaaggtatgccgggcgaagtcctgcaacactttacccgtacgcgtatcctgaacaagccgatgaatatgcaactgctgggtgatgcacagccgcacgaacgtcgcggtggcgatcgtcctgccggcgaacgtcgcttcggtggcggtgagcgtcgcgaaggtggccgtggcccacgtcgtgaaggcgcagcgccaggcgctggccgtttcagcggcgaacgtcgtgaaggcagccgtggtccgcgtcgcgaagacggtgccgcatccggtcgtcgtcgcttcggtgatgcataatcgcgtaacgcattacgctttactgtaaagtaaaagttccagccccgatcttaacaatcggggctttttttatctgctttgtactcatgtactggtacaatgctggcgcgatgcttcactgaccgaagctgttataacaccggagataaaacggatggcgacgttaacgaccacacacaccactccttcgctgctggctggcgttgtgattattgcgggtacaatcattggcgcaggcatgttttccctgccggtggtgatgtccggcgcgtggttcttctggtcactggcggcgctgatcttcacctggttctgtatgctgcattccgggctgatgatccttgaagcgaacctcaactatcgtattggatccagcttcgacaccattacccgcgatctgctcggcaggcgctggaacgccatcaacggcatttccatcgcctttgtgctctatatcctgacctacgcctacatttccgcgagcggctcgatcctgcatcatacttttagcgaaatgtcgctaaacgttccggcacggctggcgggatttggttttgcgctgctggtggcgtttattgtctggctgtcgacccgcgcggtcagccgtatgaccgccattgtgctgggcgccaaagtcatcaccttctttctgaccttcggcagcctgctggggcacgtccagcccgccacgctgtttaatgtggccgaaagcaacgcctcctatacgccttatctgctgatgacgctgccgttttgcctcgcctcttttggctaccacggtaacgtccccagcctgatgaagttttacggcaaagatccgcgcaccatcacccgttgtatcgtgctgggctcgttactggcgctggggctgtacgcggtctggttgctggggacgatgggcaatattccgcgcccggcctttatcgccattgccgcgcagggcggaaatatcgatgtgctggtgcaggcgttaagcggcgtgctgaatagccgcagcctggatttgctgctgctggtgttttctaactttgccgttgccagctcgttcctgggcgtaacgctggggctgtttgattatctcgcggatctgtttgggtttgacgacagcgcggcagggcggcttaaaaccgcggcgctgaccttcctgccgccggtggtgggcggtttactgtggccgaacggttttctgtatgcgattggctatgccggactggcagcaacgatctgggcggcaattgttccggcgctgctggcgcgcaaatcccgcaaacgctttggcagcccgcggtttcgcgtctggggaggcaaaccgatgattgccctgatcctgattttcggcgtcggcaacgcggtggtgcatctgttgtcgagttttaatctgttgccggtgtatcagtagtcaatctcttgccggatggcggctgcgccttatccggcctacaaaattaatgttgtaggcccggtaagcgtagcgccaccgggcaaaacctggaaatgtaggcccggtaagcgtagcgccaccgggcaggccagaactatcccaacagctcttctttcacctgcatcgccaggtcaaaagaatgcagccgcgcctgatgatcgaaaatctggccgttcaccatcatctcatccgcctgggtttctcgcaggatcgactccagcccgtggcggactttcgctttatcccccaccagcgacatgctcagcgcctgctgcacaccgtatttttctgacggcgaccagaagtgatcgatgttatcaatcggcggcggcagctgcgaggtctcgccccggcgcagcttcacaaacgcctgctgcatggaggtgaacaggaattctgcatcgcggttactgtcggcggccacgatattgatgcacaccatcgcatacggcttctcaaggcgcgccgacggcttaaagttgctgcggtacaggtgcagcgcctggaacagcatatccggcgcaaagtgcgacgcgaacgcaaagggcaggccaagctgggcggcgaggtgggcgctgtagagactggagccgagcagccagacgggaattttctcgccgtagccgggcaccgggcgcacatgcggattcggatcgcgggcgtcaaaccagtccaccagctctgccacatcgcgcaggaagttatcgacatcgccgctcatatgacggcgcagcgccatcatggtgcgctgatcgctgcccggcgcacgccccagacccagatcgattcggcccggatagagcgtattgagcgtaccgaactgctcggcgatcaccagcggcgagtggttcggcagcatcacgccgccggagccgaggtgcagagtgttagtatttgccgccagataaccaatcagcacggacgtcgccgcgctggcgatgccggtcatattatgatgttcagccagccagaagcgatgatagccacgtttttcagcgagacgggccagatccagagagtgttcgaaggcgtctttcgcagaagcgccctgcgggatcggtgcgagatcgagcaccgaaaaaagcggggatgtatcggtcataatgcgctcactttgttacaggctaattctttaatactgcattaaagcgtagctaaagctgttaacaaagtgagctatctgtgtaattgcgcggcaggctacaccagttccagaccagctacccgcttccagtaaccattgcagtcactgtgtgccgccagcggcagcggggcgccaccgttagcgttggcgcgaaaggccgccagcatatccagcgtttcagcgcccatcggcgacaggcgcacaatgtccaccagcccgttcatcgaagtctgttcgttgccgaggttatagacatagccgctcatcgtctgaataccgtttaacacgaacacctgctggttttcctgcgacagcacattgcgccccgtcgggtatttgatgcagcaggtttcgcactcatctttgggccggtcttccgagcgggcggtaaagcagcgcgctgaataggccagcggcagatgaccatagctcagcacttccacttcaaactgattgcggatccccagctcatcgcactggttcagcagattaaccagccagtcgcgggacagctccaccggcatacaccagcgcaccatgccctgtttgtgcaacaggcgcagcgtcacggcgttatagcagttcagcgcatgaccggcgacgaacggcagttttcgctcggcgcacatattcaccacgccgagatcgctggcctccagcataaactcgccgttctccacatagcgcttcagttcattaagttcagatgaggcctgcaccagcgccagcgtcgacagcaccacctgcttgccgctttgcgccagcgctttcgccatatccagccagtcacctgatttggtggcgcggcgcttgctgcataccgcctcgccaagataaataatatcggcttcgctttcagcggcctgctgatagaaattttccagcgtctcttttgaccagtagtagagcaccggtcctaatgcatatttcattggtttctcactgccatttacggtgataggcgcccagcgtcgtttgcgtgccttccgacatcgcccccagcgtatccatccatgccgcctgcggcgcgtaggcgtccggtgcggccatgcatttatcgatagcctgacgccagaccttagccacctggctgacgtacgccgggctgcgctgacgaccttcaattttcaccgaggcgatattggccgccagcagctccggcaacagctccagcgtgttcagactggtcggctcttccagcgcgtgatagcgctcgccatccaccagatagcgccccttgcacagcgtcggataaccggcgttttccccttcctgatagcggtcgatcagcacatcgttcaggcgtgattccagcccctgcggcgtctgttgccagcgcacaaagcgcgccggtgaacaggcgcccacggtattgggcgattcgccggtcaggtaagaggataaatagcagcgtccttccgccataatgcacaggctgccgaaggcgaacacctccagcggaaccggcgtggtgcgggagagctgtttcacctgatggatcgacagcacgcgcggcagcaccacgcgcgccacgtcaaaatggcggtgataaaaacgaatggcttcgtcattggtggccgaggcctgtaccgagacatggcgttcaatatggggataacgttccgcggcgtattcgagcatcgccagatcggcgaggatcagcgcatccgcgccgagctgcgccgccatgtccaccgcccgctgccagcgctgatagccgtcagggtgggcgaaagtgttaatggcgatgtgcaattttttgccgtgctggtggacatagctcactgcttcctggagctttttctccgtaaagttaagtccggcaaaatggcgggcgttagtatcatctttcaggccgatatagacggcgtcggctccgttctcgatggccgcctttagcgccggaagatttccggccgggcagagcaactccataatatatcctgcggttcaacgggccagcctgacccggacgcacctgagaggtgcaaaaattgttaacgaactgggattttagttaacccttcggcgacaatttttgatttgaggcagttaatcgcgtattgatgacaccaataatgctgtatttcttcgtcgtaattgttgatttgcgccgctatgtcgtttgtatgatgtggcagaataagcgcactaatcatttcagggagtaatgcttgtgttggataaactgcgctcacgtctcgttctcgcgggtccgtctttactgagtgtgcctgtgaagctcgcgcctttcgcccttaaacgccaggtactggaacaggtcctgcgctggcagtttcagcaggcgctggcggatggagaacttgagtttctcgaaggacgctggttaagtatcgaggtgcgtgacattggccttcagtggttcacctccgttgagaacggtcagttaatcgtgcgccagtctgccaatgccgacgtcagcttcagcgcggatgccagcgatctgctgatgatcgcggcccgcaagcaggatccggatacgctgttcttccagcgccgtctggtgattgaaggtgatactgaactgggtctgtacgtcaaaaacctgatggacgccattgaacctgagcagatgccgaagccgttacgcgttctgctcatgcaactggcggaatttgttgaagcgggcctgaaaacgccccctgaaactaaacctctttctgtaggtgaaccatgctgattagagttgaaatccccattgatgcgccaggcattgacgcattacttcgtcgcgcttatccgggcgatggcgaagcgggtctggtacatgatctgcgtgaagatggtttgatcacgctgggtctggtggcgacagatgacgaagggcaggtggtgggttatgtcgccttcagcccggtctctgtgcagggtgaggatttgcagtgggtagggcttgcgccgctggccattaacgaagattaccgtgggcagggtctcgcgcggcaactggtgtatgaagggctggattcactcaatgaatttggctatgccgccgtggtagccttaggagatgcggcattctatgaccgcctcggttttgagcgggcggcgcattacgatctgcattgccgctggccgggtacggaaaccgccttccacgtccatcggctggcggatgacgccttcaacggcgtaaccgggctggtggagtatcacgatcatttcaatcgcttttaagcgcaggcatttgcaggctggctaacagcgcttcaaatgaaccatccccgctgacgaggcgctctttctggcgcttcgtcagttgtttgatccggtattcgatccgcaatgcaagcgagcgttcaccaacctgcgccgtaaaggccagccgcagctcgcctttaccccgcagcgcctttgcgcctttgcccgactgatgctggctgaagcggcgggatacgtccgtggtaatgccggtatagagcgaatcatcagcggtgcgaataagataaacagaccagggcgtcattacagcgttcactatgttaaggtgagcgcaccatagcatgaggaagaagtcagatggaatcactcgccgccattaatcgctggctggccagacaacatgtgctgagctggtgtgtcacccgcgacggggaactgtggtgcgcaaacgccttctatctctacgatcccgtaaaagtggcgttctacgtgctgagtgaagatcacacccgccatgcgcagatgaccgggcaaaacgcgccggtggcgggcaccataaacgggcagccgaaaaccgtcgcgctgatccgcggcgtgcagttcaaagggaagatccgccgactgagcgaggaagaaagcgacgtaccgcgcgcgcagtataatcgccgctttccggtggccagagcgttatcggcccccgtctgggagatcctcccggacgagatcaaatttaccgataacaccctgggcttcgggaaaaaacttcactggttgcgcgactcagctgccgagtaagcgcagggcttcgcggttaaaggcgggcagatcgtccggggtacggctggtgacgatctggttattatctatgaccacttcctggtcatagaaatccgcaccggcgtttttcagatcgataacaataggtttcaccgtggtgagcttacgtccgcgtaccacttcggcgctgatcagcagttgcgggccgtgacagatggcaaacacgggtttaccggaatccacaaattcacgggtaaaggtaacaaagcgatcgtcgccgcgcagggtgtccggcgagtgaccgcccggcagtaacagcgcatcgaactcgtcaggtttcacttcatcgatagctttatcgatagtgatgctggcttcccctttcttacctttgaccgttttcccggcttccatctcaatggtgatcacctcatggccggctttacgaaacgcttcggcaggtgacgtaaattctgaatcttcaaactcgtcggttatcaagactgcaatcttcttgcccatatttcctccgctgttttgggttcagacaggtgatttcgccataaatcgttaataatgacgaagagtactgttaagtctggttcagtgacgcgacattgcaaggcggactaatctgcaaaggagatgagatgactcaggtaatgatcaccggcgcgaccggcctggtagggggacacctgctgcgtatgctcaggcagacaccggaaatcaccgccatcgccgcgcccacgcgccgcccgttagcggacgcttacgacgtgtttaatccgcacgatccgcagctcagcgatgcgctggcgcaggtaaaagatccgctggatattgtgttttgctgcctgggcaccacgcgccgcgaggcgggcagcaaagaagccttcattcatgctgattatacgctggtggtggacacggccattaccggccagcgcctgggggcgaaacatatgctggtggtcagcgccacgggcgcgaatcctcattccccctttttctataatcgcgttaagggcgagatggaagaagcgctgaaggcgcagcactggccccggctgaccctggcccgcccgtcgatgctgctcggcgaccgcaataaaaaacgcttcaatgagtcgctgatggcgccattattccgtctgctgccaggaaactggaaatccattgaggcgcgtgatgtggcaaaagccatgctgatcaccgcgctttctccggcgcaggaaggcgtaacggtactggattccgcgcagttacgggaaatcgcccaacgcgcacgggattaatcgtttccaaaagcggttcgcaggcgtagtattttccggcttaataaaacattactcctggaaaatgctatgactggtcagtcttcatctcaggcggttgcccctgtccaatggtggaaacccgcactcttttttctcgtcgttattatcggactctggtatgtgaaatggcagccgtactacagtaaagccttcactgccgccgaaacgcacagcatcggtaaatctattctcggccaggcggccagcagcccgttacaggcggcgctggattacgccatggtctatttccttgccgtctggaaagccgccgtgcttggcgtactgctcggttccctgattcaggtgctgatcccgcgtgactggctgctgcgcaccctcggacagccgcgctttcgcggcacgctcctcggcacgctgttttccctgccgggaatgatgtgctcctgctgtgctgcgccagtgacggcgggtatgcgtcgtcagcaggtttccatgggcggggcgctggcattctggatgggaaacccgttacttaatcccgcgaccctggtatttatgggctttgtgctcggctggcactttgcgttgatccgtctggtggccgggctggtcacggtgatcggggtggcggccgtggtgcagcatctggtgaaagatcgcgcgcagccggttgaaccggtggaagtggcggtcccgcaggcgcagggcggttttatgacccgctggggtaaagcgctctggtcgctgttctggagcaccattccggtgtatatccttgccgtgctggtgttgggagcggcgcgcgtctggctgtttcctcatgcggatggcgcgatcgataactcaatactgtggatcgtcgccatggcgatcgtcggctgtctgttcgttatcccaacggctgccgagatccccattgtgcagaccatgatgctggctggcatgggcaccgcgcctgcgctggcgctgctcatcaccttgccggcggtcagtctgccgtcgctgattatgctgcgtaagtcgttcccggcgaaagctctgtggcttaccggtgcgctggtggcattgtgcgggatgattgtcggcgcgctcgcgctggtgtgagatttgacaccctctcccgacgggagagggttaacatgagtggattatttaataaaggtgaaggccgttgtcacgtgcttcacgccgctcacccggctggcgatatccgccgcagcctgcgcttcacgttcggtcaccagccctaacaggaacacttcgccgttctcggtggtcaccttcacgttcgaagatttcacctgatcgctgcctaacagctgcgaacgaactttggtggtgatccaggtatccgatgatgccgtgcccagcccaatcggctgaccctgacggatctcgttatatacttcggtggtgccttccacgcccatcgcgatctgtttggcgcgtgcggagagcgaactgtccggagactgtcccaccagcaggactttgccctgataagcggtcacgttaatgcgggtgtttttcttaatctgttcgtctttcgacagcgcgctgtttacgcgtacctccagcgtgccgtcatccacttgcgtacccacggtacgcggatccgttgccgctttcgtgcccaccgctgccgttcctacgaccgcagcagctacacatccctgaagcaataatgcggaaataaggactgcgaggggcgaaaatgccttcatgtgtactccttaatcatcctggtgtggaaaaagcgtgttatcgatcagatcgcacaggcagttcaccgtcaacatatgcatttcatgaatacgtgcacttcgatgcgacggtatacgaatttcaacatcctgaggccccagaagcccggccagttccccgccgtcgtagcctgtcagcgcgacaatggtcatatcgcgtgtcactgccgcttccaccgctttcacaatgtcgcggctgttgccgcgggtggagatagccagcagcacatcccccgcatggcccagcgcccgcacctgtttggcataaatttcttcatgccggcgatcgttggcgatcgcagttaagaccacgttatcggtattaagtgcaatggcgggtaaactggggcggtctgtttcgtaacgattgatcatgctggcagcaaaatgctgtgcattggcggcagaggtgccattaccacaacagaggattttgttgccgttgagcagggactgaaccagcgtcatggcagcacgggaaatcgcatccggcaacgcttccgccgccgcaatctgggtttgaatgctttccgtaaagcagactttaattctttcgagcacgataatccctattatttcagcaattatgagtggtcgttaaaggcgtcttgtatccactcaacatcatttccggtgaaggctaccacatcgaaccggcaatccacagtgtcaaaactcccattgtgccgggcaagccacaaacgcgcggtttgcagcaatcgcaactgtttttgccgggtaacgctggccgcagcgccgccgaatgtcgccgttttgcggtagcgaacttcaatgaagaccgtcgtcggcccgtgtttcattatcagatcaatttcgccgccacgcgcatgcacgttggcggcgataaaacgcagtcctttgccttccagccagcgacgcgcgcgtacttcccacgcctcgccggtctgtttacgcgttaaccggccgggacgatctgcccctgttggtatttcagccatgataacttcctgttaatcacacaatcctgagtggcggaaaggtcgccggtgttgccgttaatctcaaagcccggcacctggcgcatttgcgagaaatgattagccagcgcccaggcatccacgcccatggcatacagacgcgccagtgaataatcgttgttcacgctgctgagcgcctgctgcatcagcgccggattgctgcccgccagcatcgggatctcgctgtattgcaggccttccatctcaagacggaaatccggaccggcaatgcctttcgcactgcgggaactggcgtacagcgtggcatggctctggctgccgttgcgcatggcgatcatcggtttgataagcgcaatttcatccggcgttgccagaatataggctgcatcaacattaccgccgccgctgatttgcgcatcgctgggcggcgccggaatggtcaggccgccgatagtgacgctctgctgcgcaggcaggctggcggtcaccgggctgccggtgagcgcgataccggaattgctgttaatgcccatcttcagttctgctgtggaaccaaatttctgttgcagcaccgtaccgccgccgagtttttgccactcatcggcaaaagcgttggtgacgcgatcgccaagcgtactgcgcggcaccagcattaacggcgcgcggtggccctgatcccagatgtggtgcgccgcatcgcgggcttcatcttccggcgacagggcgaagtaacagatattcgcccggctctcgacggtttccggctggttaagggccagcacgttaagcgccgtattgctcttcatcagctcttcgacgttagatttcagcagcggccccaccacaatgctggcgccatcctgctgaacctgggtgaggatctgatccagcggctgcgtggtggtgtcatacacttttagctgcgcgccagggttagcgggcgtgctgaccgctgaaggcggagcggctgctgtttcagtggctgccactggcgcatcagcggacggcgctggcgtagcagcctctgtcggttgtgcttccggctgcggctgatcttcaccgctgatatcgccaacctgcgccgccgacgggctgacgacgtccgcgggcgcgctgctttcttcagtggtggcggcctgcgcaacctgggcaggcgtagccggacctgatacggcagcgacgccgttcttcgccgcttcaaaaccctgctggatggtacggccaaataccgccgcctgaccgttcaacggcagcagcagggcaattttgctggtggaggccggggtaaagttctgcacgttcaccagctgcgacggcagcattttcgcgccagggttttgcggataacgcacctgccagtcgctgatgcccgctttcagcatgttgggatcgttacggttatcaaaccagacgcgttgcagatccagccagccctgcagcacgttttcatcggcattgatcaccagcgcctgcgcctgttccggcgtcatctgcgacagtgcctgccaggtggcgtctatgttggcctgcttttctttcgccgccagcagcggctcctgcgcaatcagcgcccgcaacagcgtcagggaagggcgaccctgctgggcggtaatgcccgcctgccagaatcggctttgctgatttttgtcgagttctgccggatccattttgccgaggagcgcctgcgcgccctggaaatctttctgcgcgactttcatttccgccgccagcaacgcctgctcgcgacgctgcgcgtcactgagttcctgcggcaaccgggcgaacagctcgctcgcctgctgcgttttaccttctttcagcagtgcacgaatggcgagtaattgccagttggtcttgctatcatcggagctttgctgcatctggttcaggtaataacccgaatcagcctgctctgcgccctgcatgtgcgcactgctctgatccggtgattgcgttccgcagcctgcaaaaagcagggcggccagcaccacaggcagacaacgcgtggcttttgaacgaagaaatgttgacggtaccattctgtatccagtgatatttttcaggcaatgctcaatattaaatcggcactacggacgaaacaatgaaacaacgcgaatcagctgagaattctcaaggtcagctttatattgtacccactcctatcgggaatttggctgatattacacaacgtgctctcaccgtgttgcaaagcgttgatttaattgcggctgaagacacgcgtcacacgggattactgctgcaacatttcgccatcagcgcgcggctcttcgccctgcacgatcataatgagcagcaaaaagcggaaaccctggtggcaaagctcaaagaaggccagaacatcgcgctggtttccgatgcgggcacgccgctgattaacgatcccggctaccatctggtgcgcacctgccgcgaagccgggatccgcgtggtgccgctgccggggccgtgcgccgccatcgccgcgttaagcgccgccgggctgccgtcggatcgtttctgctacgaaggattcctgcccgccaaatccaaaggccgccgcgacacgctgaaagcgctggaagcggagccccgcacgttgattttctacgagtccacgcatcgtctgctggatagcctggaagatatttgcgccgtgctgggtgaatcgcgctatgtggtgctggcgcgtgaactgaccaaaacctgggagtcgatccagggcgcgcctgtcggcgagctgctggcctgggtgaaagaggacgaaaaccgccgcaaaggtgaaatggtgctcatcgtcgaagggcataaagcgcaggaagaagatctgccggcggatgccctgcgtaccctggcattgttacaggcggaactgccgctgaaaaaagccgcagcgctggcggctgaaattcatggcgtgaagaaaaacgcgctgtacaaatatgccctggagcagcagggagagtaattctgcaagccgttaaccacttccctgcattttcagggctgtggaggcgaaaaccgcagggccgtcggcgtacagggcggctcgctgcttttaggctggtacggcttaagcccgaagggacagagcgcgaagcggcactttttatctttcggacagggggtgacaaaatcccgtgtattgcccggacaatcggtcttttttaacaggttttgccacagtttcgcgttgtagggcgacgcgtgaataaccgagatgttccgcaattttccatcgacgaacaggcccagttccccggtcgaaaaggcgttcccctgccgcaaaaaataatcccctttacaccacaggatgagcttaagattttttgacgtctgggctatcgagaagtaggtcccggtatccgggctcgccagagaatcaataattttccaggtcataacaccccttgtttttttaatttaagaaagtcgcgaatggcaaacgcgcaatcgtttagtgatgcgctaattcaccgcgctatgcggtatgatttgccttaaggccatcaagaaaattcgcgtctaaaattaacttagtttagatttacgaattcatcaaaaaacttacaaaaggtggtgttttatccggtaggaaaaggggctaacgcccctaagattttgaaggttgctaatgccagactgctttaaaggtgtcggcgcacttactatcagacgataatcatctccatatttttctgccgaaacgctttgatttcttcggctttaatactttcatcggtgataatgcagtcgatctgttcaatcggcagcacctgattaaaaccgcggcgattgaatttggtggcatcaaggacggcgaccaccttatgcgcggcggcagccatcacgccgctgatggagtagccttcgttaaaggtggtgatgccattctgcgtgtcgatgccatcggccccgacgaacatcaaatcagcgctgatgccctgtaatgaacgctccgcgatggtgccatgcatggagtgggttttatggcgcacggtgccgccgcacaccaccagcgtaatatccttgttatccgccagcataaacgcagcgggcagactgttggtgatcaccgtaatattggcgtgttttgtcaacgcttcggcaataagcatggtggtgctgccgctgtccagaataagggtcattccttcctggatcatggcgacggcggcctgggcaatacgctttttcggatcgctggcaagctggtagcgatcctccagcaccacttcctgattatcgggttccgtcagattgctgccgggtcttgctgcaccgccatggaagcgggtcgccagcccctttttttccagcaaacgcaaatctgcgcggattgtcacttctgaaataccaaaggctgacgccagatctaataccagcacgctgccctgcgcattaatcagatcaacgattgcgttccttcgttcaaatgagttcatctttatctgcctgattattaactgaccttagtgtaatcgaagggttatgaaagttgaatgccatttttcgaaaggaaatgtgagccagctcaggttgctggcccgaaagtctaactgaactgcagcagaattttgccctgcatcggcgcgccctgaagcgcttctaccgcctgcgcaaaatgcgccgcatcgccacggtgggcgataagcggcgtcagactgaggcgtttttccgtcagcagacgcgcggcgatttgccactcctcgccaggccagggtccggaatagttcatccagctgccggttatcgtcagctccttacgcaggatctggccaaaaactgacgaggggagcgtgagatcctgatgcagcgtgcctaccagcgccagctgcgcgcgcgatcctgcgatgtcaatcgacagagcgacggtttgcggcgtaccggcggtttccagcagcagctgatcaaactgacaatcggccagcgccgcctggatctgcgccgcgctcatctcccggctgttaaaggtttgcgtcgccccaagtgattttgccagcgccagtttttgcggattaatatcaatggcggttatgcttcgcgcgcccagctctctggcgcactgcatggcaagtaagccgatagtgccagctcccacaatgatgacatttttcccggcgcagccgcccagcagatggaacgcatgcaacccaacggtaatgggctcaataaaagcgccgtcctcaatcggcatgtcagcgggcagggcgaaaaggtttgcgcgcttcaccaccacatattccgcgtggccgccatcgctgcgcgagcccacgaactgatagtgtttacagagcgaaaagtattcccgctcgcactgcggacactgaaagcagggcagcaaaggtacgcaggccaccgcgtcgcctgggtgcaaatccgtgacggctgcgccgcaggagaccacatagccgctaaactcatgcccaagggtgatggggtaataatgcgcaccgtgcgcgaaaatacgcggaatgtctgagccgcacagacccgagctgatgaccttcaccagcacctcgtcttccgcattaatctgaggctgtggacgttcttcaacgcgcacctgtccctcagcatggatgaccactgatttcatacacttctccgaaaatgttatgggggcctcagcccccggagattaggaaacagtttgcgcctgttgcgccgccgcggctttctccgccatcacgaactggcgcgcgcgacgccaggtgagaaacaccccggccagatagatcacgccaatcacggcaaagccgactatgttctgccaggtaaacagctggatcagcagccaggtgaccggcgaaccgccctggtccatggaggccaccataccgcccgccttcagcgcgcctgcgttcgccgccagttgcgtatgcagaccgatagtttgcgtggtgatccacagcgtaatgcccataatgatgacgccggagatcagcgtacggaacaggttgccctgatgaaccgccactgccatagccacaaagaagccaatggtggccagatcgccgaacggcaggacctggttaccgggaaccagcacggcaatcagaatggtcagcggaataaaaatcaggctggcggagaccaccgaggtatgaccaagcagcagcgcgggatccagaccaatcaggaattcctgaccgccaaatttcgcctgtaaacgcttacgggcgtgcttcgcgataggcgtcagaccatccatgataggcttgatgacgcggggcatcagcagcatcaccgccgcggtttttaccgccagttgcagcacgtttttcgcgtcgtagcccgccagcagcccaatcactaagcccatcacaaagccaacggtcaccggttcgccaaagggtccgaagcgcttttgcacatcatcggcgctgaaatggatacggttaagaccggggattttttcgataagcgtgtcgaccagaaccgccaccggaccgagataggccgatgaaccgtggggtatcgcaataccctccaggccaaagaagtcgcgggtatctttcgcaaaccagtcgcccagcttgtaaacaaaggccgcatgcgccaccacgcccagcatgccgatccagtaggagccggtcgccagatgcagcatggcgccggtaaaggtcatgtgccagatgttccagatatcgacgttcaccacgcgggtcatccgcgtcaccagcatcagaatattgacgccaatggcgacaggaatggcgatcagcgcgatctgcgaggcccaggtcatgggtgacgatcccggccagccaatatccaccacatgcaggttgatctggaactgctccgccatggcctttgccgccgggccgatggaatcaagcatcaggccgatcaccagcccgataccgacaaagccgatgccgatatgtaggccggacttaaagcaatccccgagcttcatccccagcaatttcgaaaagaggatgatcaccagcggcagcatcaccgtcggcccaagatcgaggatataacgcatgatttcgctaaacataagcttaccctcgcagaatggtcaggattttttgctgcaacggctcgatgccgacgccggaaacgaaaggcataccgtgaacgacagggatgctgccgaaggttctgtcgacgcgggcggtggtgcagatcaggtgcgccccgtccatgtaagtttcgatttccgttacccggcactgcaccagttcgagcgggatgttattggcctcgcacagctctttgatctcttctgctgccatagtggaggtcgccacagcgccgccacaggcgacgattactttacgtttcatagggtattccttttattatcagtatattaataaggtcagagacagggttcttgctcaagcagcctttgcctgaatagcgacgccagttcagcatccggcgcatgaagcagcgcctccagggtggccgggttttgtagctcgctgaataaccggcgcagcagttttagctgggcgtcggggttttcaacgatcagcgcgatgatcagcgaaacggcaatctcatcgtcgtcatcggcgcgccggaacagcaccgggctgtccgggcggatcaggtaaatggcgggcgatttggcatgtagcgcctcgcagtgagggatagcgacggcatgctgttccagcgcaattcccgtcgggaaggcggcttcccgctccagcaatgcctgcgggtaggtgtcgtgcaccacaccatgggccagcatcgtttcgccaatatgctgcaacgcatgctggcaggagggaaagtcgatgccggttcggacaaagagttggctcatagatcctcttgcagattcagacgatgtcaggtgaacagccatagcggtaagcgcgcagcacatcctggatgcggtcgaggatcagcgcgtgcggtgtggcgttcagttcgttgcgggaaagccgttcaaactgcaccggcatgtactggctgatcaggcccagcggcaacgtgatttcaccaagacctgcgatcagtttttcgacgctctggcgaatgcgcggatgcggccagtagtagcgaatgcgatcggaaaggctgaaatggatatccaccatcgactggctccatgtcgggcggtagtactttttccagtagccaggctcgtcgagcattacctcgtcgatcacctccagcacatggctgcggcgctccggcggaaccagcgcgttttccatctgcgccagcgcaaatatcgcttcgcgcagggcaaaggtcagcgccgggccaactttcagaatggcaaagtgatcttccaccagcgcccggtaagcttcgcgggtctggtaatccgtggagtgcgcctcatagaccagcggcgtggcggcgatccagtcggataactcacgcgccgcctgcggctgataatggatgatttgcgtatggtcgaattcgacgcccggctgcaccaccagggcgatgacgcgctgcatggcgtcctccaggcctgcggcgcggaaggccgcctgatgggtttccagggtggcggcggcatcccttgcgcgggtgacgtggacgctgccaatgctgctggcttcgccgccgggcaccggtacttccgtgccaatcacgtaggtgagctggcgtttttgttccggtgtggccgtggcttcggcggcagcgcacagacgggcggcgcggctggcgacgacggcgggatcgagcgcaacaggatcgtctgcgcaggacatggaagcatcaagatggatcttgctgaagcctgccgcgacgtaggcccggataagctcgacggatttctccatcgcgtcagccgcgttttcgttctgccagcagttggggccaaggtggtcgccgcccagaataatgcgctcgcggggaaagcccactccggcggcgatgttaaacacaaagtcgcgaaaatccgcgggcgtcattccggtatagccgccatattgattgacctgatttgaggtggcctcaatcggtaccttttcctgcgtatacaaatcaaagcgcagtgccgcttcgatcaccagcgggtgggcggagcagaccgagcaaatgcccagtcgttcgcccgctttatggcgcgagataatttctttcattttgtagggtccgtttggttttgtttagtttcgttatcttctgtggctgaggcaaaagtaatgttccgtttctgaagcctgctctcaaagtttgccttcgcagccgcacacgcctatcactttgcgcaccacctctttcatggcggctttcgcaggttgcagatagtggcggggatcgctggcctgcggatgggcctgcaggtagtctttcagggcggcggaaaacgccatttttaactcagtcgccacgttgactttgcagacgccaagcgcgatggcgcggcgaatgtcggcatcaggcaaaccggatgcgccatgcagcaccagcggcacatccacgcactggcggatggcggcaagacggtcaaaatcgagttccggctcatggtcatacaggccatgcgcggtgccgatggccaccgcaagggagtccacgccggtgagttcaacaaaggtttttgcctgctccgggctggtgaaacgcgcatcccggctgtcgacatgcagatcgtcttcctggccgccaagccgccccagctccgcttccacgctggcgtcatagcgatggcagaactgcgtaacgcgctgcgtcagcgccacgttttcactaaagggcagatgagagccgtcgatcatcaccgagcgaatgccagccacgactctggcttcaatatcggcaagggtttcatggtgatcgagatgcatggcgagaggatgatcaagcgcgcgtgccagatccgcggcaatggcgatcaggttgccggtgcccgcatagctgaaggtgcccggcgtaccggcgacaatcagcggcgcgcgcagttcagcggcggtttctgccaccacctgtaaagtctcaaggttatggatattgaaggccggcacggcatagccttcctgctgcgctttggtgagcatggttctggtcgagataagatacatactttctccgttacctttcgaatgatttcattcgaaataaaataaaggtatttgaaagtaatttttgtgatcctgatcgaagggatggattttcgaaacaaagaagtgaggacaaaaaaaacctcatctccggatgaagatgaggtcgggtactacgccgttatggctatagcatcaggtgaccggagcggggttgaacaccgccagctggttatgcaggccccactgatcggagaaggttttcttacgcccgctggcgacatccagaataaagtggaacagccgccagcctacttcctcgatggtttcttccccggtggcgatagtgcccgcgttgatgtccattaagtcataccagcgagtcgccagctcggtgcgggtcgccattttgatcaccggtacggccatcagaccgtaaggcgtaccgcgcccggtggtgaacacctgcacggtaatgccggaggcgacctgctgggtgccgcagacaaaatcgctggcgggggtggccgcgtaaatcaggccgcgtttcgtcgggcgctggccaggcgacagcacttctgaaatggcgctctggccggatttggcgatagagccgagggccttttccaccacgttcgccagcccgccttttttgttgccgggggacgggttggcgctgcggtcagttttgcccatatccagatagttatcataccaggccatctcttcgagcaggcgtttacccacttcttcattgatggcgcgcggggtgagcagatggatggcgtcgcgcacttcggtgacttcagaaaacatcacggtcgcgccgcagcgcaccagcagatccgaggcgtagcccaccgccggattcgccgtgacgccggaaaaggcatcgctgccgccgcactgggtgccgaccaccagatcggaagccgggcaggtttcgcgctggcgcaggttaagttttgcgagatggcgttccgccacggcgagaatgtcatccaccatggatttaaagccgacatgctgctcatcctgcaaacgcacgatgctggccccgtcagccggaatagccagcacatcgctggtgccttccagcaggcgttccggttgcagtttttcacagccgaggccgaccaccatgacttcgccgccaaagttcgggttgagggaaatattgtggatggtgcggataggcaccaccgctgccggggcgttgatcgccacgccgcagccgtaaaggtgattcaggccgaccacgccatcgacgttcgggtatttcggcagtaaatcgcgttcaatgattttcaccacgtaatccaccacgcccgccacgcagtgcacgctggtggtgatgccgagcaggtttttggtgccgacgctgccgtccgcgttgcgatagccttcgaaggtgtaaccttccagcggcggcaaaggttcaggtacgcgggtcgccagtggcagggtattgagcggcggggcttccggcagttcaacggtcgattcgtcaatccagctgccacgcgcgacatcacgcaccgcataaccgataacctcgccgtaacggatgatttcgccatgagccggaatatcggtcagcgccactttatgcccctgcggaatgtgctctgtgagttcaagcccgtcagggaagcgggtgccggctttcaggccattgtcattgacaataattgcgacgttatcagtgtcatgaaccttaatataaaaggctgccggcgaatattgtcggatttcgatatcggccattgtccagtattctccagtcaatttatggggcaaaaatgagtaatttaagcgtcgctttctggttattaatatttaaagggagcggtaacggaataaagcatggcaggtgtcacagttgaataatgtgatcgccatcactcatcgttaccctcgcaagccccaccgcgcagacaagataaaatatgtgcatcagcgcccagcaccttgtgcagatgctcaataactttgttctttatgatgagtaaattgagcattgcaacaatgcgcaaccggcgtacgttatttatacttattctcgttttctttgtattctggtgttttaaataatgccatcaggaattgcatttaatcagaaaataattaagagcgggattttgctggcgacagaaacgcataatttaagtatcggttaattcaaggtatatacaatgaataacactgttttcccgaacacatttaaagctgcgctggcggcgaatcaggtgcagattggctgctggtcggcgctggcaaacccgtttaccacagaagtgctgggccttgccggttttgactggatcctgctggacggtgaacacgcccctaacgacgtactttctttcgtgccgcagctgatggcgctcaaaagcagcagcagcgcctctgtggttcgcgtaccgaccaacgatccggtggtgatcaagcgcctgctggacatcggattttataacttcctgatcccgttcgtggaaaccgaagccgaagccgcgctggcggtagccgccacccgttatccgccggaaggcattcgcggcgtatcggtatcccatcgcgccaatatgttcggcaccgtaccggattacttcgcgcagtcgaacaaaaacatctcaatcatggtgcagatcgaaagccaggccggcgtggataaccttgacggcattctcaccactgacggcgtggacgcggtattcgttggaccaagcgacctggcggcaagtctgggctatctcggcaacgccgcgcacccggacgtgcagcgtgtcattcaacacatttttgcccgcgccaaagcgcacggcaaaccggcaggcattctggccccggtagaggttgatgcccgtcgttatctggaatggggcgcgaccgtagttgccgtcggcagcgatttaggcgtattccgcgccgccacgcaaaaattagccgacgcctttaaaaaataaccacgacgacaagagagacataattatgacgatgaaagtgggtttcattggcctgggtatcatgggtaaaccgatgagcaagaacctcatgaaagccggttactcagtggtggtggtagatcgcaatcatgatgccgtgtcggaaatggttgccgccggtgccgaaaccgccgcaacggcaaaagaagtggccgaacagtgtgaggtgatcatcaccatgctgccgaactccccgcacgtaaaagaagtggcgctgggggacggcggcattatcgaaggcgcgaaaccgggcaccgtgctgatcgacatgagttctatcgcaccgctggcgagccgcgaaatcagcgaagccctgaaagccaaaggtattgatatgctcgatgcgccggtcagcggcggcgagccgaaagctatcgacggtacgctgtcggtgatggtgggcggcgataaagctatttttgataagtattacgacctgatgaaaaccatggcgggatccgtggtgcataccggcgatattggcgcaggcaacgttaccaaactggccaaccaggtgatagtggcgctgaacatcgcggccatgtcggaagccctgacgctggcgaccaaagcgggcgttaacccggatctggtcttccaggcgatccgcggcggtctggcgggcagcaccgtactggaggcgaaagcgccgatggtgatggatcgcaactttaagccgggcttccgtattgatctgcacatcaaagacctgtctaacgcgctggatacctctcacggcgtgggcgcgcagttgccgctcaccgcggcggtcatggaaatgatgcaggccctgcgtgccgatggtcatggcaacgacgatcacagtgcgcttgcctgctattacgaaaaactggcgaaagtggaagtctcccgctgatccccgcgcccggtggcgtcacgctgccgggcctgataagtaagccgaaaagctaatccctcctgcgacatgcggtaacaggctacagatatgaaaatcgtcatcgctcctgattcatataaagaaagcctgtccgcttcagaagtggcgcaggcaatagaaaaaggctttcgggaaatttttcccgcggccgagtatgtctgtgtcccggtcgctgacggcggcgaaggcacggtagaagccatgattgccgccaccgggggcacggcgttcgtcgccccggtcaccggcccgctgggggaggtggttgacgcacgctggggcatctccggcgacgggcagaccgcctttatcgaaatggcggcggccagcggcctggcgctggtgccgtccgcgttacgcaatccgctgatcaccacctcgcgcggtaccggcgagcttattctgcacgcgctggaacagggcgcgcaccatatcattatcggtatcggcggcagcgccaccaacgacggcggcgcaggcatggtacaggcgctgggcgcgaagctgtgcgatgccaatggtacggagatcggcaacggcggcggcagcctgatgagcctgaattcgatcgatattacggggctggatccacgccttgcccggtgcaccctccgtgtggcctgtgacgtcactaacccgctgctcggcgaccagggcgcgtcgcgtatcttcggcccgcaaaaaggagcgagcgaggcgtgcattattgagctggacaaaaacctcgctcactatgcggacgtcattaaaaaatccctgcatgtggatgtgaaaaacgtaccgggcgcaggcgcggcgggcggtatgggggcggcgctgatggcgtttctcaatgccgagttgcgcagcggcattgaaattgtgaccgacgcgctgaacctcgaagaacatattcacgattgtacgctggtggtgaccggcgaaggccgcatcgacagccagaccattcatggcaaagtaccggcgggcattgcctcggtggccaataaataccataagccggtgatcggtatcgccgggagtctgtccaccgatgtgggcgtggtgcacgatcacggcattgatgccgtgttcagcgtattaaccacggtctgcacgctggaagaggcgtttcgcggcgcgtctgacaatatttatcgcgcttcgcgcaatattgccgcgaccttgcaggtcgggatgttgagcgaagggtgacatcgcggcgcaaaccctctatacttcgcgccgaagctgaccagacagtcgccgcttcgtcgtcgtcccccctcggggggagacgggcggaggggaggaaagtccgggctccatagggcagggtgccaggtaacgcctgggggggaaacccacgaccagtgcaacagagagcaaaccgccgatggcccgcgcaagcgggatcaggtaagggtgaaagggtgcggtaagagcgcaccgcgcggctggtaacagtccgtggcacggtaaactccacccggagcaaggccaaataggggttcacaaggtacggcccgtactgaacccgggtaggctgcttgagccagtgagcgattgctggcctagatgaatgactgtccacgacagaacccggcttaccggtcagcttcaacttcttacagaaccccgctccggcggggtttttgctttctgctgtatgcgttttgattttgccgggtggcgcttcgcttacccggcctacaaactgacgcttacccggcatggcggtgttgtgcccctgtaggcccggcaagcctgcgccgccgggcagggtaaaaacaacctacatcggtaaatcaatcagcaatgcacgcagcggcgtatcggcgacgagggtaatattcggctcatcacggataaaggccccgtcgccgcaggtcagggcctgttgcccggtctggtgcgtcacggcgtgcacgctgccatggatcgactgcaaataggcgcgcgggccgtggagatggaaactcagctcttcgcctttttccagttcgatatgatgaacccacgcctgctgacgcagttgcaggctgccctggctgccgtcaggcgaggccagcagttgctgcgcatgatctgccagcgaaattttctgcaccagcgaattttcccgctcggggctggcgtccagccacagctgcatacgcgtcagggatttatctttgctcaggttgtgttcgctgtagctgatgcccggctgcgtggcgatcagcagcgcatcgcctgccttcgcctggacatgatgaccttcactgtcgcggtactcggcttcgccttccagaatgagatttaaaatatccacttttggataggtacgcggctggaatgatgcccccggcgccagcacttcctggttcagcacccgcaacgaggcatagcccagcaggttcgggtcaaaataatggccaaaggagaaggtgtagcgggcctgcaaccatccgaagtcggcctttccgcactgtttggctgttcttgtcgtgatcataatgtctgccctctctttacacttaaacaatggtaaaggtatggacgctgcattgttagccagatattctgcccggtatgttcaaatttcctgaatgaaaacgacatggctaaagaaagagcgttaaccctcgaagcattacgggtaatggatgcgatcgatcgacgcggcagtttcgcggcggcggcagatgaactgggccgtgttccttcggcgctcagctacaccatgcaaaagctggaagaagaactggatgtggtgctgttcgaccgctccggccaccgtacaaaattcaccaacgtgggccgtatgctgctggagcgcgggcgtgtgttgctggaagcggcagataagctgaccaccgatgcggaagcgctggcgcgcggctgggaaacccatctgacgctggtgaccgaagcgctggtgccgacaccgtcgttcttcccgctggtggaaaagctggcgacgaaagccaatacccagctgtcggtgatcaccgaagtgcttgccggggcatgggagcgtctggagcagggccgggcggacatcgtcatcgggccggatatgcattttcgttcctcgtcggaaattaactcgcgcaagctgtataagatcatgaatgtgtacgtggcggcaccggatcatcccattcacgatgaacctgaaccgctctcggaagtgacgcgcgtgaaatatcgcggcgtggcggtggcggatacggcgcgggaacgcccggtgctcaccgtacagctgctggataaacagccgcgtctgacggtaagttctattgaagataagcgccaggcgctgctggcggggctgggcgtggcgaccatgccctatccgctggtggagaaagacatcgctgaggggcgtctgcgggtggtcagcccggaatattccgccgaagtggacattatcatggcctggcggcgcgacagtatgggagaagcgaaagcctggtgcctgcgcgagatcccgaagctgtttatcaataaataagcgactcctccgcccggaggagccagcaggatcaggggacctgttttggatccggtccaaaacggttttcgcctggcgtaccgctctggcagttaaaggcgatgatcaccagccagccgatcaccgggatcagcagcaataacaaccaccacgccgagcggtcagtatcatgcagacgacggaactgcaccgcccaccacggcagaaaaatcagcacaccataaattgtggtcagcacgccttcgccgctgccccgctgaaaccccaggatattatccacaatccccagcaccgcggtcagcacgatgttgaccagaataaacatccagtactctttgcggcgcgcacgcccgcgaaacccaatgtagttcctgagaacttttaaataccagtccatgttagcgcctcaatctgtggttaattcactgttttatcagcaatcatattaataatagctatcaatatttcgtcggtaaatatcatgcgtctgaattaatcgaagcgatcatttttacgctggcattccggggaggatcacaaaacgcgttgcgtctgttgtgatcctcctcacctgaaatgatcccgttctgtgaggctgctcgctttttaatcgccggagtcggttttcacgaattcattcactgccgcgctgatttacagccagcgcgcgcgccgccatgctgacgtcatccggcgcttcctgttcaagactgcgggccaggtcattaagccgcgccggactgagcaggttccggaagatgtaaggatgcttctcaccttcgccggtaaaccagacgtccagctcacgactgatgctgcgcaacgcctgtagcgcgtcggtgaactgccgggccataccggactgcgcgccatatttgcgtatccagatccgcagcacgatggcccgcgtcacggcgctgtaagcgcgggtataccacagggcgcgggtggtggtgtcggtgaggcggcgagtgaatgccgggctgagatggttatcgctctgcaactgctgggcgagggtctgcatatgaccggcgaggaacagcgtctgctgccgttccagttcaataagctgaaactgttgctgacccagttcgggatcgtcggcgggcatcagcggctgaaacgcctgcgcccagtttgcgctgcgggtatccagatgcagcaggtgcaatgcctgctggaaggtggcgggcggctggctgtgagattgcagcacgcggccaagcagcgtcggggttttgcagctccattcgtagctggcgctcagcaggttgctgaacagcgtctcaagatgcagcggcaggggcgctaccgcatgggtttgcagccaggcgcgcagaagggctgcgggcgtgctgtccggctcgcgcacctgccgggcaaggccgtagagattgatttcattaagggagtcggtcagctccagatcggggatccactcccagttaaggcgcagggtaacggcttcgggcatcgcgccctcctgaccgctgaaccactgcaaacgctggtggaactcctccagtaaatagcagggcagcagcgtccagccgtattcgatgccccacatatcaaactccagccatttggtgaagcccgtcagggtggtcaggttggggttgttggcaaagccgggacggtaatccagctcggtggctttgaccgaggcgcgcacatcgccgggcagcgcctccagcgcggtttttaacatatgccgcggccagcttttgtcccggtaatcgcgcagcaccagctggcgaccctgacggcgcactgactggtacagcaggtttaatacgcctttccacgcttcgttgctcatgtcgggggtggaaagggagagccgtaatccgcgtaccgacggtagcagccggagcagttccggaatggcatggccgaacagccagtcggtaaagctggcgtcatcgccgcgcgattccgtgagaaagaactccgggaatttcgctttctgttcgctgcagtcgggggtggcttccccctgtaaccagagttgcagatggtgctcatcgcagtagcggctgaccttttgcagatacaaaagcgcatggtcgcggcgatggatcaaatggcgaatgtcgccggggcggcagccgggcgagggcgcggcaagatcggcgatcagcgactgctgatgaatgataaggccattgaaatggtgcgccttcaggatggcggcaatgtgctggaaatagtgccagtcccatattttcggcgtgttgacttccagcaataacaagggtgcagcggacattatgacctgtttcctggggaagcggttcactcaccatacgggcaagcgcccggacgatcgacagttatttatcacgaacggagaaaaatgatggcgaaaggggatagggttcagcttcattattatgaatataccgatgaggataccggcgcacgggttattcgcctgacgccgccggatattatttgtcatcgtaactacttctatcaaaagtgtttcctggatgagggacgccagttaattttcgccggcgagttcagcggcacgcgcaattattatttactcgatatcgccagcggcgaagcaaaacagcttaccgaagggccgggggataatacctttggcggttttctttcaccggatgagcaatatctttattacgtgaagggcgagcgcaatctgatgcgcgtgacgctggcgacgcaggaagaaagcgtggtgtatcgcgtaccggacgactgggtgggttacggcacctgggtggcgaattccgactgcaacaaactggtgggcgtggagattcatcgcgacagctggcgacccatcagcgactggaccgtcttccaggagttttatgccgagcagccgcgctgccgggtgatccgcatctcgctggaaaatggcgagcgggaaaccctgctggaagaaaatcagtggctcgggcaccccatttaccgtcctttcgacgacaacacggtggctttctgccacgaagggccgctggatcaggtggatgcccgcatgtggctgatgaacgaagacggcagccacatccgcaaagccaaagagcctgcgccgggggagagctatacccatgaattctgggtgccggacggctcggcgctgatgtacgtcacctacgtcaaggacagcccggtgcgctggctgtgccgggtaaatggcgacaacggtgaagatgagaagctgatcgccatgccgccgtgctcgcacgtgatgagcaacgacagcggcacgctggtggtgggcgacggctccggtaaacccattgatattgccgataacgcgggctatggcgatgccaccgatccctatctttacctgttcgatattgcccgcaagcagacgcacaaagtggcgcgccacagctcgtcatggcgcgtgctggacggcgatcggcaggtgacgcatccgcatccgtcgttcacgccggatgaaaaacaggtgttgttcagctccgataaagacggcctgccggcgctgtatctggcggatattccagaccacgtattacgcagcattcattcctgagagagcgcgctatgttaaagaaattcttgcccgtcacggcatcgttgttgctggtctgcgcctgtgcggcggtggcccagcctgcggaaattcgtatctcctggtggggcggcaacagccgtcatcaggcgacgctgaaagccattgagctgtttgaaaagcaaaacccggatattcaggtgaaagcggaatatgcaggctgggaggggtatctctcgcgtctgacggtgcagatggcggggggaaatgaaccggatgtcattcagaccaactggaactggttgccgctgttttccaaagacggcgacggtttttatgacctgctgaaactgaaagagagcatcgatctcagccagtatgatccgcagtcgctgcaaagcgtcatggtgaataacaagctgaacggtattccggtggcgatgaccgcgcgcagtttttattacaaccagaaactgtggcaggaaatgggcgtcgcctatccgcaaagctgggatgaattaaaagccgccgggaaagcctttaaagcgaaggacgaaaataaatatccgctggtgctcgactatatggagtcgatcaccctggtgcagtcatggatggtacaaaaacataatatcgccgccatcgacgaaaaagccgggaaatttaattacaccccgcagcagtgggtggagtttttccaggtctataaagatctggtggacagccacgtcttcccgtcgacccgcgtgctgtcgtcatacggtaaatccaacacctgggaaatgaagccctggatccaggggcaatggggcgggatctatatgtggaacaccaatgcggtgatgtacgagaacaacctcgccgcgccttataacaagctggagctggggccgttctttatgctgccaggcgctaaggacgcggggctgttcctgaaaccgaccatgatgttcagcgtggcgaaaaccagtaaacatccgcagcaggcggcgaagctgatcgacttcctgatgaacgatccggcaggcgtggcggcgatggggctggagcgcggtacgccgctgagcaaaaaggccgtggcgcaactgtcatcgagcggcgtgttaaaggatgacaatattaccgttacggggatcaagtcgtcgctggcgctgccgcataagatcccgacttcgccttactttgataacccgcagctggtggcgctctggcatgacaccattcagaacattgaccagggcaacctgacggttgaacaggcggcgtcgcagtttgccaaaaaagccgggcgcattttacagcgggccgtcaaaaaatgatcgccttcagcgccaccctggcctgtcagtacgacacggctttttcgccctttccggccgcgcaatttggtcacgggctggcctggctgtcggccagcggctttgatgccgccgagctgtgcatcaatgattacgagggtgtggaggtggcggcgatctgcgaggcgttaggtcgtgcgggtcttggttgtaccaccatcgccaccggccaggcgcgtaaacgtgacgggctgacgctgctgtcggcggataaaagcgtagtgcgccgcacgcaggcgcgactatttgaacatattgacgccgccgcgcagcttggcagccacgtcaccattggatcgttgcgcgccacggatctgccgctggataaagggcagtatatgagcgagctggcggcggcgctgtttccctgcgtcgagtacgcgcggcgcaacggcgtggtgctgatcctggaggcgctcaaccgctatgaagtctgtcagttgcacagcgcgcaggagatgatggattacctggcgttcagcgatgcgccggaaaacgtcggcgtgctctgggatctgttccacgccagtattgaagatgcggattatgcgcaggccatcgccacgctcggcccgcggctgcgccatgtgcatctggcggattcgaaccggggatttccggggtacggacatttaccgctggaggaggtctacaccgcgctcaggctggcgggctatcagggggcggtatcgctggagtgcttgtgtaggccgtcggcgcaaaccgtgatcgacggggcgggggaactggtggcgcggctgcggcgtctgtaaacgccgccgccgcgcgggtcaggtcattcgctgtcgcggctgccgaaacggctatcgcgaccgtgcggctcatcaagatcctgccacgggccgatggaaataataccggtcgggttaatggtcttgtggctgcaatagtagtgggtgcggatgtgcgcaaaatccaccgtttctgcaatacccggcatctgccagatatcacgcaggaagccatgcagattcaggtaatcgctgatgcggtgcttatcgcatttgaaatgcgtgacgtagaccggatcgaagcggatcaatgtggtccacagacggatatcggcttcagtcagacgatcgccggtgagatagcggtgctggccgaggatctgctccaggcgcgacagcgaatcaaacagcgcggtgaccgcctcgtcgtaagcggcctggctggtggcgaagcccgctttgtagacgccgttgttcacagtgtcatagatccagccgttcagctcatcaatctgcgactgcaactccgccgggtagtaatcccccgcgcgggcgccctgcgcatcgaacgcggtattgaacatgcggatgatttccgccgattcattactgacgatggtctggttctttttatcccacagcaccggcacggtgacgcgaccgctgtagtgcggatcggcatgcagatagagctggtagaggaagtcgtgctgatagagggtgtcgccggtcgccgccgggaaattgtcgtcaaaggtccagccgttttccagcatcagcggattaaccaccgagacatcaataaacggctccaggccttttaatttacgcatgatcagcgtgcgatgcgcccacgggcaggcgagggaaacgtagagatgatagcggcctttttcagcggcaaatccaccttcaccgctcgggcctggcgcgccatcggcggtcagccagttacgaaaagcggaaaccgaacgcttaaaactgccgcccgtcgatttggtgtcgtaccaggtgtcgtgccagacgccgtcaatcagttgtcccatcacgttctccttcaggttgggcagatgcgcaaaaaatcacaggccaggttagcgaagcgccacctggcaaaggttgacaatgcccggcggcgctacgcttgcgctggcctgcatactacgtcagcagtttagtatagaagccttaccattttttattcagtacacggtcgatgctaaatgcacccggcccggtgatgcccagcagcaggaagccgccagcgatggacagatttttcatgaacatcagcgcattcaccccttccgcaaagttattgtggaaaatgaaagcggtcagcagggtaaagcctgcggtgaacagcgcggtggtacgggtcaggaaaccaaacaggatcgccagaccgccgccgaactcaagcagaatggtcagcggcaggaaaaagcccggcacgcccatcgcttccatgtactgttgtgtacctgcatacccgttgatttttccccagcccgcatagataaacaggattggcatcagaatacgcgctaccaggaaaccaacatcttgtaattttttcattttactctccagaaatctcatgcggtatgcaagtgtgattgttcaggcagttacggcgtctggcgcacgtttgccgtcgatggagaggataataggcgtagcgttaagagattgttagcaaggaaaactgtcaatctttatcaaatattctgagtaataacaggcgggagaaatatacccgacggcgatccgccgggcaggggacaggttaacgcaggtgttgctgacgtaacgtcgtttgcaccaggcgccaggcgctccacgcagcaaaaccgcgcttcccccagcgtaccagcatattaggattgcggatggtgcgaatagccagcaggctactgcccaccaacgcccatgagcgcaggcttaacagcgtattccatccgcgatcgtaagatacggttctctcttcccagtcgcgacggctggcggcgagatccaggcgttgctgctggatctggctcagcagcacggccttacgcctttggcgatcaatctgactgctcatctcaatcatcctccagcaacgaacgatcgttggacagctcctgacgggtatgacgcagcagagtagaccggcgcgctttacgcagggtccatatagcaccaatcaatgcgccaatcagcagtaccgccgtcgtgccaatcatgacgttcagacggtattgcgggtcaatggcccagatgatcagcaccatcagactcatcagtccgaaagcggcgaacagcatggtcagacctaccatcaggagcagctggaagagattcgctttctcttcttccagctcaaccactgccagccgcagacgcgtttccaccatctcaacgatgatggtcacaatgcgctgcccgatgcccagaacgcttttaccgggcccgtttgtgtgacgtgaactatccataatcaacgacgcgaaatcaggacgcccagcactacgccaatcgcagcaccgatgccaacgccagtccatggattctcacgtacataatcttcagccttaccggccgcttcgcgtgtctgtttagcgataatgtcactggtctcgcccagacggtaacggctttcatgcagcgcacgttcagccttgctacgcagtttactcagctcttctttcgattttgacccggagctattcagcacttcttccagggtgtccgtcagggatttcaactcagcgcgcagatgttccgtattggtatcttttgacatagttctctccagtgagtgagtgttaacttcctttaataatcccgagcctcaagcgctttcagttcttcctgagcctctttcagcttatgttctcttttgaacaccttatccgcatcgcctttttgcttcgcttcctgaagatcctgctcgcgttcggcaatctcttctttctgatcggcgatcttctcctgatgatcggcgcgcaatttgctgtccgtgcaattggctctgacttcgctaagtgctttattcaggccgtcgatacggctctgattattgtgcttctcggcgtaacggatttctttttgaatatcctgctccttttcctgacaaagggaagcagcctgtgaagcggcactcagtgaaaaaagggctaacgccagtgcggtgcggtatttcattcttgaaaccttccattgttgctacgggcctcaacatgaggcgccgaaatccagttgattaaaagagtaagatgggtgcccgtgtactaagcatagtaacgaacggggagaaaaccaaaatgcgggcgaagtttcggaataattgaagttttcaacccagccgatgtggcgtatcgcgcagtcgggaaagccataccgcggctttatcatcgtcatcctgttgcgcgatgatatagccatggggcagggtgcgatcgagcaccactttggcggcagcgctctgcgcgctggaatcaaacttaattaacagcgtgtcattctgcggggtaatgctgttaaagcgaatgccgttagcatccagatgatgccagatagaaaagccgtcaggcacgctgacgctctggctggccgggcgaatagccagcgttgactcacgctgttgtagcgtcgcccaggcaaagaaaaagatcgtgaacagcatgactgctgccaccattaaagcaacgcgcttcatcgacgtgcgttgaataagcatccggttattcctgctttccatattttttcttccataacaccaccagcgtaccgatgagtccaaacaccagcagtacgaccggcagcaacatcaggcaggacatcagcgcatcctcatacttgaggaaaaccggcgtcttaccaagaagatagcccagggtcgtcaggatcaccacccagagcagaccgctcatccagttgaaaaactggaagcgcgcattgttcagaccagagatcccggcaatagttggtaacagtgtgcgaacaaatgcaataaatcgccctaacagcagcgcagacaggccgtgtttgtggaacatatggtgcgcgcgctggtgataatgcgcgggcagatgcgacagccagttctgcacaatgcgggtgttacccagccagcggccctggatgtagctcagccagcagccgaggctggcggcggtagtcagcagcgctatggtgagcggatagctcatcgcgcctttggcgatcagtacgcccaccagcactaacaggctgtcgccgggcagaaaggcggcgggcagcaggccattttccaggaacaaaatcataaacaggacgaaataaagcatgccgatcatggaaggattcgccagcgtctcgaaatcctgactccacaatgcattaagtagctgagtaaatagttccattcgttattcctggtacatcggttaacgtcacgccagatcggatcctgtgcacctatacgtgcgggcaaattgcatctaattgtaacaaatgccggagttctgcgtctcaaaatttatgaaatgtaagaattgattttgcttgtggcgtaggggggagaccagagtatttacaaaggctgacactctataccttttgttactgcggggagcgcagcaagcgcaggagcgcctgctgtggaggataaaaatttattttaccgcgttcgcggcagcatcaaggtgaaccacaggattatctgcaaaaagatagcggtcagcgttgaattcgaaatcatcgctggtttcgttaaacagcatctgtttagtgttttccagatgctgccacatcgccagcttggcggcatgcgggtctttacggatcagggctttaaggatctggtcatgatcgtcgcaccagttatccacggtgcgtaaatcgatatgatcgtgcagctttttccagtacgggttatgaatacgctgcgtccacatcttttcgacaattgccgccagcgccgtattctgcgtggcaagggctacctgcacgtggaactgcaaatcccattcggaatcgcggaagcatttctcctggcgcgcccgatcctggatttccatcagcttcatgatgtcctgtttcgtcacctgggtggcggcgaattcggcaatattgctttcaatcagctggcgggcctgtagcagttcaaacgggccgtagttggcgaactcaagcgtttcgtccggcacctgctggtatttaggctggttcgacatcacgtggatcccggagcctttacgcacttcaacgtagccttccacttccagcatgatgatggcctcacgcaccacggtacggctgacgtttttttcatccgcaatgaagcgctcggcaggcagtttatcaccaacgagatacacgccgttttcaatacggcttttcagctcagcagcgagctgctgatacaaacgacgcgtgtcagtgatttccatatacactccaggcaggataagacagattagatttgttataccacttttacgccattctcaccaccgcagaaaagtaaaaagccgccccggacaacggggcggctcgtatgcaaatggtttaacagcgcgttttaactttgtgtcgcaggtccgccataggcggctttttccgcttccagctccgcggccgatttacttttcagcaccgtccagatcaccacagcgcccatgatgtcgaacactgccagtaccgcgaacagtgggctgaagccgatggtatccgccagcgcacctactaccagcgcaaacatggtgcttgccgtccaggccgccatgccggtcagaccgtttgcggttgccacttcgttacgaccgaacacgtcagaagagagggtgatcagcgcgccggacagggactggtgagcaaaaccaccgatgcacagcaggccgattgccacatacgggctggtgaacaggccgatcatgccagggccaatcatcagtaccgcacccatggtcaccaccattttacgggacacgatcaggttcacgccaaaccagcgctggaacagcggcggcaggtaacccccgacgatacaacccaggtcagcaaacagcatcggcatccaggcaaacatcgcgatttctttcaggttaaagccgtagactttgaacatgaacagcgggatccaggcgttaaaggtaccccaggccggttctgcgaggaaacgcggcagggcgatgccccagaactgacgggtgcccagaatctgccatacggacatttttttgccgttgttggtctggtgctgcgcttcctgaccgccaatgatgtagctacgttcttcttcggtcagttttttctgatcgcgcggatgtttgtagaaaatcagccatgccatagcccaggcgaagctcagtacgccggagataatgaacgccagctgccagctgtgcatcacgatggcccagaccaccagcggcggggcaatcatcgcgccaatagaggaaccgacgttgaagtagccgacggcgatagaacgctctttggccgggaaccactcggaggcggctttcagacccgccgggatcatcgcggcttcagcagcacctaccgcaccacgcgccagcgccagtccaccccagcttcccgccagcgctgttgcgccgcagaagatggcccaggtcacggcgaagaccgcgtagccaactttggtgccgagaatatccagcacataacccgccaccggctgcatgatggtgtaagccgcggagtaggccgcaataatgtaggaatattgttgcgtggaaatatgcagttcttccatcagcgttggtgccgccgcagcgatggtattacgcgtcaagtaacccagcacggtaccgagcgtcaccagcgctatcatgtaccaacgtaaccctttaattttacgcatgtaaacctcatcgttatgttatttccgcctctggcggttcacctcccgaccaggtcgggggatgttatgtaacggggggagcgaaatcgggactgattcccggtacggtccaaaccttgccattgtcattcgtgcgaaattcggtatccgtaccgttaatccgggtgagtaactcacctgtaatacattccgtcggtctatgttttgcgacggcagaaagataacttgtcatacaactttaaaaggtgagtgacatcacaaaagtgcgtttctttgtgtggtctttattttcggtcagcgaagccagagctggcgcggcctgcgggggtgtttaccccaatcggggtagtttatttgtcaggatttattgatctaactcacgaaaatatcttcggtctgtagaaattggtgtgataactttgtcagcattaaggcatacatctacgctctttttagaggaagacgataatgactccgtttatgaccgaagatttcctgttagataccgaatttgcccgccgtctgtatcacgattacgcaaaagatgagccgattttcgattaccactgccatttaccgccgcagcagatcgcagaaaactaccgctttaaaaacctgtatgacatctggctgaaaggcgaccactacaaatggcgcgccatgcgtaccaacggcgtgccggagcgcctgtgtaccggcgatgcctctgaccgcgaaaagtttgatgcctgggcggccacggttccgcataccatcggcaacccgctgtaccattggactcaccttgaactgcgtcgcccgttcggtatcagcggcaaactgctgtcgccgtccaccgctgacgagatctggcatcagggtaacgaactgctggcgcaggagtccttctctgcccgcggtatcatgcagcagatgaatgtgaaaatggtcggcaccaccgacgatccgattgactcgctggagcatcacgccaccgtcgcgaaagacacttccttcagcattaaagtgctgccgagctggcgtccggataaagccttcaatattgaacaggcgacctttaacgattacatggcgaaactgggtgaagtctccgacaccgagatccgccgtttcagcgatctgcaaactgccctgaccaaacgtctggatcactttgcggcgcacggttgtaaagtctccgaccacgccctggacgtggtgctgtttgcggaagcgaacgaggccgagctggacagcatccttgcgcgtcgtctggcaggcgaaaccctgagcgagcatgaagtggcgcagttcaaaaccgccgtgctggtgttcctcggcgcggaatatgcacgccgtgaatgggtgcagcagtaccatattggcgcgctgcgtaataacaacctgcgccagttcaaactgctggggccggatgtgggctttgactccatcaacgaccgtccgatggcggaagagctgtcgaagctgctcagcaaacagaacgaagaaaacctgttgccgaaaaccatcctttactgtctgaacccgcgcgataacgaagtgctgggcaccatgatcggtaacttccagggggaaggcatgccgggcaaaatgcagttcggctccggctggtggtttaacgatcagaaagacggcatggaacgtcagatgacacagctggcgcagttgggcctgttaagccgctttgtcggtatgctgaccgacagccgcagcttcctgtcctatacccgtcatgaatatttccgtcgcattctgtgccagatgattggccgctgggtcgaagcgggcgaagcccctgccgacattcagttgctgggcgagatggtgagaaatatctgctttaacaatgcgcgtgactacttcgcgattgaactgaactaaggccgtttgaggttgatatgcaatacatcaagatccattcgctggacaacgtcgcagtcgcactggctgacctggcggaaggcgcagaagttaccgtagataaccagacggtgcggctgcgtcaggcagtaggacgcgggcataagttcgccctgcgcaccatccatcagggcgaaaacgtggtgaaatacggtttgcctattggtcacgccacggcagacattgctgagggtgaatatattcactctcataatgcccgcaccaacctgagcgatctggacgagtatagctatcaacctgaacctcaggctgaagccgcgcagggtgcggatcgcgacgttgagatctaccgccgggccaacggcgaagtcggcatccgcaatgaactgtggatcctgccgaccgtcggctgcgtgaacggtatcgcccgtcagatccagacgcgctttctgaaagaaaccaacgatgccgaaggcaccgacggcgtgttcctgttcagtcacacctacggctgctcgcagctgggggatgaccacatcaacacccgcaccatgctgcaaaacatggtgcgccacccgaatgcgggcgcggtgctggtgattggcctcggctgtgaaaacaaccaggtcgacgccttccgcgaaaccctgggcgactttgatccggagcgcgtccactttatggtctgtcagcatcaggacgacgaagtggaagcgggccttgaacatctgcatcagttatatgaagcgatgcgtcacgaccaacgcgagccgggcaaactgagcgagctgaagtttgggctggagtgcggcggatccgatggcctgtccggcatcaccgctaaccccatgctcggtcgtttctccgactacgtcatcggtaacggcggcaccaccgtgctgaccgaagtgccggagatgtttggtgcggaacagatcctgatgagccattgtgtcgatgaaaccacctttgaaaaaaccgtcaccatggtgaacgatttcaaacagtattttatcgcccacaaccagccgatttacgagaacccatcgccgggcaacaaagccggtggcatcactacgctggaagagaaatccctcggctgtacccagaaagcgggggccagccaggtggtggacgtgctgcgttacggcgagcgtctgcaaaagcacggtctgaacctgctttccgcgccgggtaacgatgccgtcgccaccagcgcgctggccggtgccggttgccatatggtgctgttctccaccggtcgcggtacgccgtacggcggttttgtaccgacggtgaaaatcgccactaacagcgagctggcggcgaagaaaaagcactggatcgattttgacgcgggtcagctgatccacggcaaaatgatgccggagctgctgaacgaattcgtggatgtgattgcggatatcgccagcggcaaaaagacctgcaacgaacgtaatgatttccgcgagctggcgatctttaaaagcggcgtaacgctgtaaacctgttgtcgggtttgtcgggtggcgctgcgcttacccggcatacaggtactgtaaatgccttgccgggcggcgactgcgtcttgcccggcctacagaacctgcaaatcaacccaggcccggcaagctggcgccgccgggcaataattcttaactgcgcagcgcgtttttcgccagacgttcatcttccgcctggcatgctgccgcggtgaacagcacgtcggtggaagagttaagcgcggtttcgcaggaatcctgcaacacgccgatgataaagcccaccgccaccacctgcatggcaatatcgttcggaatgccgaacatattacacgccagcgggatcaacagcagcgaaccacccgccacgcccgatgccccacaggcacacagcgaggccaccacgctcagcagcagcgccgtcggcaaatcaaccggaatacccagcgtatgcaccgccgccatggtcagcacggtaatggtgatcgccgcgcccgccatattgaccgtcgcccccagcggaatggaaaccgagtaggtatcgcggtccagattcagtttttccgccagcgccatgttgaccggaatgttcgccgccgagctgcgggtaaagaatgccgtcacgccgctttcacgcaggcacagcagcaccagcggaaaaggattgcggcgaattttccagaacaccagcagcgggttgatcaccagcgccaccaggaacatacagccaatcagcaccagcagcagctgcgcgtagccgtagagggtggcaaaaccggtttccgccagcgtcgccgacaccagaccgaaaataccgataggcgcaaagcggatcaccagcttcaccataaaggtcaccgcgtccgacacatcgttaatcaggcttttggtggagtcgctgccgtgacgcagcgcaaagcccagaccaatggcccacaccagaatgccgatatagttggcttccagcaacgcatgtaccgggttagacaccatgctcatcagcaggccacgcagcacttccgtaatgccggcgggcggcgtgatgtccgtcgcgccggtcaccagttgcagggtggatgggaacaggaagctgaataccacggcggttaaggcagcggaaaaggtgcccaccagatagagcaccagaataggacggatattggttttctgaccgtggcggtgattggcgatggatgccatcaccagcatcagtaccagcaccggcgccaccgctttcagcgcgccgacgaacagcgtgcccagcagaccggcagcaagcgcggctggttttgatacccaggcgagcagaatgcccagcactaagccgatgaggatttgttttaccagactgccgtgcaccagacggtgcagcacacctgtgaagtgttgcgtactcatgaggaattccttagatggtgttgtagtgccatcccggacatcctcttaagggatgttcatgtcgggatgtaacaaatgtttgcaaagaggagtatacgcattcgcaggcggcgggaaagaacaagaggctggattggtggcaagtgtcgtgttttttaactgtctgataacatatttgtgacatggtcaacaattaaaccttctccgttgccggagaaggttctgtttgtcagccctggagctttttcttgtcgttctggtgattcacccaggcgttaagcagcagggttatcgccagaataccgcccaccacgccaagggagatggcaatcgggatatggtagaagtcgacgatcagcatcttgataccgataaacaccaggatcaccgacaggccgtacttcagcagcgcgaagcgttccgccacgcccgccagcaggaagtacatggcgcgcagaccgaggatcgcgaacaggttagaggtcagcacgataaagggatcggtggtcaccgcgaaaatagctggaatactgtcgaccgcgaagatcacgtcgcttaactcaaccaggatcagcaccagcagcagcggcgtggcgtacagcagaccgtttttacgcacaaagaagtgctcgctttcgatcttgtccgtcatgcgcagatgaccacgcagccagcgcaccagcggtttatcgccaatacccgcttcgtcttctttcgccagcgccattttcaccccggtgaacagcaggaacgcgccgaagacgtacagcagccattcgaactgggagatcaaccagctaccggcgaaaatcatgatggtacgcagcacaatcgcccccagcacgccgtagatcaatacacgacgttgcaatgcaggcggcacggcgaagtagctgaacagcatcagccagacgaagacgttatccacggccagcgctttctcaatcaggtaaccggtgaggaaggcgagcgcctgcggatcggccacggcacggccttcggtgctggcgaggtaccaccagaaggcggcgttaaacagcaaagagagtgatacccataccagtgaccagacggccgcctgcttcatggacatcgtatgagcgccgcgacgcccctgaagcagaaggtcgatggcgagcatgatcacgacgacaactgcgaatccgccccagagcagcggtgtgccgacagtattcataggaaattccttacataaaaaaaacggctgacgtcgaaagacgatagccgtttattttagatgcacgggtcctcgcctttcggcaaggtctcacttacatccttaaggatgcccggcgaccggatgcttgcgcatcgtaatgacgaccaaccggcaatgaagttactcccctttgctggtaacaaaatatgacagagatcgcattccgtcaatgggtcgtaacaactgttttacatagctttacgccaccggatcggcagccgcttcgctgtcagccgggaaaatcacgccggtctggcggcggatctccgtcagcaagttcgcggtaatacggctgatggcgatgcccggatggttcacttcgttgttttccaccagatcggcaaagcgctctgcctcatacagcatggtattgatatgctgcggttgggagagatcctgtggcttgccgccgcgcggcacaaaagatactttctggcattcggagattttttctatcaccagcgagccttcttcgccctggatctcgctcgccagcaccgattcactcactttggaatgttgcagggtgacgctgaaatcgccgtagttaagcaccaccacgccgtgcgcgtccacgccgctgtccagcagactggccgtggcctgtacgctgtgcggttcgccccataacgccaccgccgaggccaggcagtaaaagccgatatccataatcgagccgttggaaaacgccggattaaaggtgttcggattttcgccgtccagatagcgctgatagcgggaagagtactggcagtaattaataaaggctttgcgcacctttcccactttcggcagtgactgttgcagcagcaggaaattcggcagcgaggcggttttaaacgcttcgaacagcaccacgccattttcccgcgcgcaggcaatggcggcttccacttcacgcagattggaggccagcggtttttcgcagatcacatgctttttatggcgcaggaacagttcgctttgcgaaaagtgcagggagttcgggctggcaatatacaccgcatcaatatcatggctctgcgccagcgcctcaagggaggtaaacagatgttcgaccggataatcgctggcgaaatgctgcgcctgttcaaggctgcgggagtaaacggcggtaagggtatatttgccggtctcatgggcggcatcgacgaactggcgggtgatccagttcgtcccaatgactgcgaaacgtatcataaacggcgttgtgctccgtaaaaggggaccattcgccaatgtagcacgtcagtgtgacaaaaccagtgcgctgcgccgcagaagtcaggcgacgatcatgccagcgcctgatgcgtcagccacagacgagtatcaaactccagttgatgatagtgcggctccatatgacagcacagctgataaaaagccttgctgtgatccttctctttcaggtgcgccagttcatgcaccactatcatgcgcaaaaaggcttccggcgcgttgcgaaacaccgtcgccacgcggatttccgcttttgccttcagcttgcccccctgcacgcgggaaatggcggtatgcagaccaagggcgttattcagcacatgaattttattgtcgtaggccactttgttgattggcggcgcattgcgcagaaactgacttttcagatcctgggtatattgatagagagccttgtcggtggtgacgttgtgcgtatcgggataacgcttttgcagcacctcgccgagccggttctgctcgatgagcgtcgtaacctgggccagcagattttccggatagccctggagatagagaagtttgctcatcattgccccacgatagcagtcaaaaaagggtatactcacgcccccattcaggggatcacaccgaattttaccatccaggagggccgatgagccattcagacaacggtttccgttcacttaacttaaaacgttttccggagacggacgacgtcaacccactgcaggcgtgggaagcggcagacgaatacctgctgcaacaactggacgaaactgaaatcagtggcccggtcctgattttcaacgatacttttggtgcgctggcctgcgcgctggtggagcacaagccttacagcattggcgactcctacctgagcgaactggcgacccgtgaaaatctgcgccataacgatctcaacgaaggggatgtcaccttcctcgacagcaccgcgccatacccggccgcgccgggcgtcgtgctgattaagatcccgaaaaccctggccctgctggagcagcaacttcgcaccctgcgcacggtagtgacgccgcaaacgcgcatcatcgccgggaccaaagcgcgtgatattcacaactcgacccttgagctgtttgaaaaagtgctggggccgaccaccactaccctggcctggaaaaaagcgcgtctggttaactgcactttcagcgccccggcgcttaacgatgcgccgcagaccctgagctggaaactggacggcaccgactggactattcacaaccatgccaacgtcttttctcgtaccgggctggacatcggcgcgcgcttctttatgcagcatctgccggataacctggaaggggagattgtcgatctcggctgcggtaacggcgtgattggtctgacgctgctggataagaatccgcaggccagcgtggtattcgtggatgagtcgccgatggcggtggcctccagccgtcttaacgtcgaaaccaacctgccagaggcgctggatcgctgcgagtttatgatcaacaacgcgctgtcaggcgtcgagccgttccgttttgacgccgtgctctgtaacccgccgttccatcaaaaacatgcgctgacggataatatcgcctgggagatgttccaccacgcccgccgctgcctgaaaatcaacggcgagctgcgcatcgtggcgaaccgccacctggattatttccacaagctgaagaagattttcggcaactgcgaaaccattgccaccaatcagaaattcgtggtgctgaaagcggttaaaaccggacgcagacggtaaatttcccgcccggtggcgctgcgcttaccgggcctacgcggctcatgtaggccggtgcaagcgcagcgccgcccggcaaaggcatacttatatctccagcgccagccgggtaccctgcgcaatcgcgcgacgggcgtccagctccagcgccacatcgcagccgccgatgagatgcacgatttttcccgcttcgcgcagtggctccgccagttcccggcgcggctcctgtcctgcgcaaatcaccacatgatccaccgcgaagagttgtggatcgccgttgatcagcacatgcagaccggcatcgtcgattttttcgtagctcaccgccgggatcattttcacaccgcgcgccagcagggtcgcacggtggatccagccggtggttttgccaaggccttcccccggtttgctgactttacgttgcagcatcacgatctgccgcggacttttcggtaactgcgcgccttccggccgcaggcctccgggctgatccagagtggtatcaattccccattcggcgcaaaactccgcgatattctggctggtggactcacccggctggcttaaatacatcgcggtgtcaaaaccgatgccgccgctgccgatgatcgccacccgctcgcccaccggttttttatcgcgcagcacgtccagatagttcagcaccttcggatgcttgatcccctcgatcggcggggtgcgcggctcgatcccgcaggcgaggatcacctcgtcaaagtctcccagcatgtcaggcgtgacccgctggttcagccgcagatcgacgccggtcaccgcgatcatggtgcggtagtagcgcagcgtctcgtaaaactcttctttaccggggatctgtttggcgacgttaaactgtccgcccggttctgcctgggcgtcgaacaaggtcacgctgtggccgcgcgccgccgcgttaaccgcaaaagacaacccggcggggcctgcgccaatcaccgccagctttttgatcttcaccgccggtacgatcggcattttggtttcatgacaggcacgggggttgaccaggcatgaggtcactttcccggcgaagatctgatccagacaggcctgattacagccgatacaggtgttaatttcgtccgcacgtccggcctgcgccttggaaaggatcgccgcatcggcgaggaaaggccgcgccatcgataccatatccgcgtcgccgcgcgccagaatctcctccgccacctgcggatcgttaatgcggttagtggtgattaagggcagtgacactttgcccttcagcttacgggtcgcccaggtaaaggccccgcgcggcaccggcgtggcgatggtcggaatgcgcgcctcgtgccagccgatgccggtattgataatgctggcccccgccgcttcaatggcctgcgccagctgcacggcctcctcaaaagtgccgccgccttccaccagatcgagcatcgacaggcgatagataataatgaagtcgctgccgacccgctcccgcaccgcgcgcaccacttcgacggcaaaacgcatccgtcgcggatagtcaccgccccattcatcgtcgcgctggttggtgcgggcggcgaggaattcgttaatcagatagccttccgatcccatcacttccacgccgtcatagcccgcttcacgcgccagcgcagcgcaacgggcaaagtcgtcgataagcgcgaggatctcctcgtgcgtcagggcgtggggtttaaaacggttgatcggtgcctgaatggcggaaggcgcgaccgggtgcggctgatagctgtagcgcccggtgtgcagaatttgcagggcgattttgccgccctcgcggtgcaccgccccggtgatgatctgatgatggggcacctggctggcatcacagagcaccgcgccgccttccatggtaacgccggagaacgccggagccacgccgccggtgacgatcagcgccacgccgtgccgggcgcgttcggcataaaaagcggccagtcgttcggcaccgtcagggcgctcctcaaggccggtgtgcatggagcccatcagcacgcggtttttcagcgtggtgaaacccagatcgagcggggcgaaaagcgacggatagcggctcataatctcttccagtgtaaaattattgttatgtggtcggatgagttactaatttagccagcgcgggggcaaaggtaaaagcgggatcgaatgattgtgatagaactcaaagaacttccccggtggcgctgcgcttaccggggctacgcttaccggggctacgaaaccgcagaaaccccaggccgaataagcgcagcgccatccggcatgatttaaggcgccgttgcgcgcaccagtcccggcgcctgccacatcgaggtggtcagcccgctgtccaccagcccaagctgatccgcatacaccgcctgccatttctgcatcatgccgtcatacagctcccggtgtgccgggttgggcgtaaattcccggctccagctcaccagccgctcgccggtggcggccatatcgtcgaacagtccggcgccggtacccgcggcgatggcgcagccgagcgcggtggcttctttcacgtccggcacacgcaccggcaggccggtcacgtcgcttaaaatctggctccacagtgcgcctttcgcgccgccgcccgcaaataccagcccatcaaaggtgacaccggagaagcgggagatctgcgccaggttgcaggcggaaacaatagctgcgttctcctccagcgcgcgaaacagcgtggctttattgcatttttccggatcgatggagaggttaataaacgacggcgcggcgtgataccagtgcttaaaatgcatggcgtccgagaaaatcggcattacgccgtgggagcctgcagggacgcggcccgccatctcttccatcagcgcataggcgtccatccccatgcgttcagcgatcagcttctcctcggcgcaaaacgcgtcccggaaccagcgcatggtcaggccggtgaaaaagctgatcgactccgcctgaaccatgccggggatgacgtgcggattaacgcggatattcatatcgggatcggtgcgtacctgcggcagattgaccacctgctgccagaaggtgccgccgagcaccgccgtctgcccggcgcgcaccacgcccagtcccagacagcccagctgcacatcgccgccgcccatcaccaccggcgtgccctcgcgcaggccgcactgcatggcggcagaatgcgtcaccgcgcccagcacggtgccggtctcttttacgggggagaggatatcggcgcgcagcccggccatatccagcagcgccggacgccagtcgcgtgagaaaagatccagcatgccggtggtcccggcgttggaaggatccaccgccagttcgccggagagttttgccgccagccagtcgctgatcatagtgatggtcgccgcctgacgataaatatccggccggtgatgcgccagccacaacagacgcggcatggcgctcagcgccagcgtctgcccggaaacctcgtacacttccgcttcaaagcgatcgtcatggatctcttttaattccgccacttcgcggctggcacgggcatcaacgttggcgcaggcccagatcgcctcgccgttgcggtcataaagcacgataccttcgcgcatggagcagcaggcgacggactgaatattagcgccggtcagctgcgcccgcgtcagcgcctggtgaatgcactggcaggccagctgccagttggtggtgagatcgaactccatcgagccgggcacgttctccacgctcaggtgtttccactcggcctggcctgcggcgatctgccgcccctgtaaatcaaaaattaccgcgcgaatgctgccggtcccggcatctaaggctaaaagataactcatgagcttgcctcgctgttggcgcgcggcaggccggaattactccgccagtgccaggatcgcgcgtgctgtcgtctcttccgtcaccaggccattgatacggcgacctttgagtgcggcataaatcgcctctgctttttcgatgccaccggccgcgccgacaatggtcggtaattgcgccagttcatcgagggtgacgccgagcagttcccggtggatgtcgaggttttccacccgctcgccgtctgcctgcaagaaataccccagaatatcccccaccgcgcctttgcgggcatacatcagctgttcgccttcgctgatatagccggagcgcataatggtggcgtcgcgtttctggttgaccgatccaatgcccaccacggcgacgtccgcggcagtggcggcgaggatcacatcccgcacgctggattcgcgttttaagatctccgccacatccgccgacgacacccgcaggggggccgggatcatgctgatgctacaggccgcgtccagctggccgatgccggtcatatacggcccgacgccgccggacagcgtcaccaggcggatctgctgtgagctgataaaaccgctcagatgctggatacagctcatggtggtttcgccaaagcccaccgccagcagctgccccggcgacagcacgcccatcagcgactgcgccgcgccaatccccagccgcacgctcatggcgggggtattcagcgcgggcagcacgcgggtgatcttcagcccaaaccgctgttgcagttcggtttccagcgccagacagccctcataacgggaattgatctgcacgcggatcacgccggactgccgccccttttccagcaggcgggagatcttcagccggggcagccccagccgttcgccaatatcattttgcgttaagccatcgtggtagtagcaccaggccacccgcgccaccagctcttcctccgataacgtcagcccggcaaagcggctctcatccgtaatgcgtttttcgctcatatgatgaactcttataaaattttagatcaaatgttctcatgcgccgctgaataaaatgtgagcgcgatggcaaaagcgatcttttgtccctgcgcaaaacaaagcaacgatccgaatgcaaaaaagtgtgatccgggcacgggtattaatatagctcaccgtctacgctttttgaacattgtgaatttttaaaatcatatgttcataaccggagccagaatgatccctctcattgaagcccgtgacgtccgcaaacagttctccggcgtgcccgttctgaaaggcattgattttacgctgcttgccggtcaggtgcatgcgctgatgggcggcaacggggcggggaaatccacgctgatgaagatcatcgccggggtggaaaccgccgacagcggcacgctgcacatcaacggcagtgcctaccgccgcctgacgcccggccaggcgcatcagctgggcatctatctggtgccgcaggagccgatgctgtttcccaatctgacggtgcgggaaaacattctgttccgcctgccgcgcagcgggaataccgatgacgtgctgaatgaaaaattacagcagctcaactgccagctgaatttgcaggccgccgccagcacgctggaagtggcggatcagcagatggtggagattctgcgcgggctgatgcgtaacgcgcgcattctgatccttgatgaacccaccgcctcgctgacgccgggggaaacggatcggctgttccggcagatccgcgccctgcaaaggctcggcgtcggcatcgtgtttatctcccacaaactgccggagatccgcgccctggccgacagcgtctcggtgatgcgcgacggcgcggtggtgctcagcggcgcgctcagtgaatttgacgatcaggcgttgataggcgcgatgaccccagccagccgcgcccatcatttaagcgactcgcaaaagctgtggctcgcattgccgggcaatcgccgcacccagccgcaggattttccggtgctgcgcgtggaagacctgaccggcgaaggctttatcgatctggatcttgaggtgtacgccggggagatcgtcggcctggccgggctggtaggatccgggcgcaccgaatttgccgaaaccctctacggtctgcgcccggtacgcggcgggcgcgtatggctggaaaatcaggagatcaccagccgggatacggcctcccggctggcgcgcggactggtctatctgccggaagaccgccaggtgtccgggctgttcctcgatgcgccggtgcgctggaacacagtaacgctcaacgaaccctccgtctggcagcaaaaaagccgcgaagcggcggtggtggagcgttatcaccgggcgctgggcatcaaacttaacaacgccgatcagacggtgcgtactctctctggcggtaatcagcaaaaagtgctgcttgcccgctgtctggaggccaatccgctgctgctgattgtcgatgagccgacgcgcggcgtcgacgtttccgcgcgggcggatatttatcagctgctgaaaagcgtggcggcgcagaacgtcgcggtgctgatgatctcaagcgatctcgatgaattccccggtctggccgatcgggtggtggtgatgcatcaggggatgcgcagcggtgaactggcgcagcaggcgatcaatgtcgatcgcatgatggcgctggccttcggaggacaggcatgaagaccttacttaaaaaccgcgagctgagcgcttttctggcgatccttgccctctttgccgtgctggtggccctcgatccggcctacctcagcctgcaaacgctggggatgatttttgccagcagtcagatcctgatcctgctggcgctgggggcgacgctggtgatgctgacgcgcaatattgacgtctcggttggctcgacggtgggcttaagcgccattgccgtcggggtggcgctcaataatggctacggcctgccgctcgccatgctgtttgccctgagcatcggtgcgctggcgggggcgttcaacggcctgctggtggtcgggttgcgcattccggccatcgtcgccacgctcggcaccctcgggttataccgtggcgcgatgctgctgtggaccggcggtaagtggatcgaagggctgcccaccagcctgaaatcactgtcggtgccggtggcggcgggcgtgtcgcccctcggtctgctggtattagccgtactgggcgcgggggcctggtggctggcgcgcacggcctccgggcgggatttttatgcggtaggggataacctcgcggctgcacggcaactgggcgtggcggtcaaccgcacccgtatgctggccttcaccttaaacggcgtgctggcggcctgcgccgggatcgtctttgccgcgcagatcggttttgtgcctaaccagaccggcagcgggctggaaatgaaagccatcgccgcctgtgtgctcggcggcatctcgctgctcggcggcaccggcacgctgatcggcgcgtttctgggcgcgttcttcctcacgcaaatcgataccgtgctggtgctgtttaagcttccggcctggtggaacgactttatcgcggggctggtgctgctgggcgtgctggtgctggacgggcgtctgcgccaggcgctggcccgtcatcagcgccagctcaaatacagccgttttcagccgggccacaaggggagtaagcacgtcgcccgctttccgcatcgcaaaaataaagaggtggcgtaaatgaagctcaactgggagtggtcgctgctcggtctgctggtgctggagatcgcgctgttcggcgcgattaacccgcgcatgctggacatcaacatgctgctgttcagcaccagcgactttatctgcatcggtatcgtggcgctgccgctgacgctggtgatcatcagcggcggtatcgacatttccctcggctccaccattggcctgtgcgccatcgcgttaggggtgatgatgcaggcgggctggccgatgggcctcgccatcgtactgacgctggcgctgggtctgctgtgcggcctgctgaacgctgcgctaattcactataccggtatcagcccgctggtgatcaccctcggcacgctctatctctacggcggcggggcgctgctgctctccggcatggcgggagcgacaggttacgagggcatcggcggtttcccggacagctttaccgccttcgccagcctgacgctgttcgggctgccggtgccgctggtgctgttcggcgtgctgacctttgccttctggctgctcgcccatcgcgggcgtttcgggcggcatttgtttttgattggtcagaacccacgggcagcacgttatgcggcgctaccggtgaacggtatgccctacgtgctgtacgggctggtgggggtggcgtcggcgattgccgcgctggtgctggtctcttacttcggatcggcgcgctcggatctggggcgcgatttgctgatgccggcgctgacggcggcggtgctgggcggcgcgaatatctacggcggatcggggtccattctgggtaccgcgctggcagcgttgctggtggggtatctgcaacaagggttacagatggtcggcatccccaaccaggtgtcgagcgcgttgtcaggtgcgctgttggttgtggtggtgatggggcgttcgctgagcctgcaccgggaatgggtgcgcacggcctggcgtcggcttctctcgcgaaaaacaatcggagcataagatgaaagcaaaacagatagtgcagcttagcgcgctggcgctggcaacctgtgtggcaacggcgcaggccgccgaccgcatcgcctttattcccaaactggtgggcgtcggcttcttcaccagcggcggcaacggcgcgaaagaggcggggaaagatcttggcgtcgacgttacctacgacggccccaccgagccgagcgtttccggccaggtgcagctggtgaataacttcgtcaaccagggctataacgccattatcgtgtcggcggtgtcgccggacggtctctgcccggcgctgaagcgggcgatgcagcgcggcgtgaaagtgctcacctgggattccgacaccaaaccggaatgccgcagcatctatatcaaccagggcacgccggaacagctgggcggcctgctggtggagatgaccgaaaaacaggtgacgaagcctgatgcgaaggtggcgtttttctactccagcccgacggtgaccgatcaaaaccagtgggtgaatgcggcgaaagcgaagatcgccaaagatcatccgcagtggaaaatcgtcaccacccagtttggttataacgacgccaccaaatccctgcaaaccgccgaggggatcttaaaagcgtatccggatctggatgcgatcatcgccccggacgccaacgccttaccggcagcggcgcaggcggcggaaaacctcaagcgtaccaacgtggcgatcaccggcttcagcacgccgaacgttatgcgcccgtatgtggagcgcggcacggtgaaagccttcggcctgtgggacgtggtgcagcaggggaaaatctccgtcaacgtcgccagccagttactgaagaaaggcgatctgaacgtcggcgacacggtggaagtgaaggggcttggccccctcaaagtggagccgaacagcgtacagggctaccagtatgaagcgaagggcaacggcattgtgctgctgccggagcgcgtggtgttcaccaaagataacatcggcaaatacgatttctgacgggggagagcatggcagatttagacgacatcagagaaggtaaaaactttggccttgaaacgccacaacagaatacgctgttcgccctgaagggctgcggcgcgctggactgggggatgcagtcgcggctggcgcgtatttttaacccggcaagtaaccgcaccgtgatgctggcgtttgaccacggctattttcaggggccgaccaccgggcttgagcgtatcgatctgtcgattgcgccgctgttcggcgaaaccgatgtgctgatgtgtacccgcggcgtgctcagaagcgtggtgccgcccgccaccaacaaaccggtggtgctgcgcgcctccggcggcaattccatactttcggagctctcgaatgaatgcgtggcggtggcgatggaagacgcgctgcgcctcaacgcctgcgcggtggcagcgcaggtgtatatcggcagcgaacatgaacatcagtccatcaataacatcatcaagctggtggatgccggtaaccgctacggtattccgacgctggcggtgaccggcgtcggcaaagagatggcccgcgatgcccgctatttttccctcgccagtcgtattgccgccgagatgggggcgcagttcgtgaagacctattatgttgaggagggcttcgaaaaagtgaccgccagttgtccggtgcccatcgtcatcgcgggcggtaaaaaactgccggagcgcgaggcgctggagatgtgtttccgcgctatcgatcagggcgcgtccggcgtcgatatgggacgtaatattttccagtccagcgcgcccctcgccatgctgaaagcggtgaaaaaagtggtgcatgacaatatgagcgcccacgaggcgttcgaattctggcaggaagaaaaacagggagaggcgcgatgaacgtgacgctggtggagatcaatatcaaaccggagcgggtcgatgagtttctggcggtgtttcgcgccaatcacgaaggggcgatccaggaaccgggcaacttacgcttcgacgtgttgcaggaccccgaagtgaatacgcgtttttatatctatgaggcgtaccaggatgaggcggcggtgctggcgcacaagcaaacgccgcactatctggcgtgcgtggagaagctggacgacatgatgtcggagccgcgtaaaaagcgcagttttatcgggttgttaccggagtaaggcgaccctgttcccggcgctgtcaaacagatgtaaatgccgcgcatccgtgctcatggtcagcggatgacgcggcgggtagttcagctgctggaatgacttcaggcagcacgcctgcccggccagcgtaaaccataccagcgtggcatccccctgtaattcacacagccgggtggtggcgctgaaggtgagttcgccgctgctctcggggcggatatgttccgggcggatggcgacgaaaagcgcatcaccctcaagcacgccatcaggctggcgtgacagcggaaaatgcagctcgtcgctgatactcaggccgccatcgcgccattcggcctgcaaaacgttaatttttggcgtgccgataaactccgcgacaaacaggttcgccggggtgttgtagagttccagcggcgtccccgtctgttcaatattgcccttgttgagcaccacaattctgtccgccagcgtcatggcctccacctgatcgtgggtgacgtaaatcatggtgttgccaagcctgttgtgcagctcctggatctcctggcgcatctccacgcgcagcgccgcatccagattcgacagcggctcgtcgaacagaaaaacctccggctgctgaacaatagagcgcccaatcgccacgcgctggcgctggccgccggagagatgttgcggcaggcgatccagcaatgcttcaagcttgagcattttcgcagctccggcgatgcgttgcgtaatttctgcgggcggcgtgttcatgtttttcagcccaaagctgaggttctgccgcacggtcatgtgcgggtaaagcgcgtaggactgaaataccatcgacaggctgcgtctgcccgcaggctggtgggtgacgtcctcatcgcccatcgctatcgttccgccatcgggcgtttccagcccggcaataatacgcagcagcgtcgatttaccacagccggacgggccgaccagcacgatgaattcgccggaggcaatatccagcgacaggttttcaataatggtgtttttgttgtactgcttgtgaatatttctcagggtgagggcggtcatgtgaaatcctttttaatggcctatctgtataagatattaatcgccgttgagcttgttaaaaataatcagatgtatttgtcttgattatatttttgcatttacttttcgccgcaaagtttagcgataaataaaaaccgaaatgtgactgaattatcgttaaacataaatcactcttgttaacttacaggccgtttgccgcgtgcgatgttttatttaacacgcgtcaggaataacatggagatcaggatgaaaagtacaacacttgccacatggaccgcatcactcttattaagtgtttgtcttactggctgcggccctgatgagcagcccgccgacaccgcggcgaaaacgccgattaaattatgggtgacgccagtcgagaacgaagaagccttctggaagaaaatggtcaccgagtggaatagcgatcccactcatacgccggtggaatttacccctattcccgttgccagcagttccgaagaagccattatgaacgcgattgcctccggcactgaaccggatatcaccagtaatatatttattggcttcgcctcacagcttaatgaaattaatcagctggaagatctctctaaaatgccgggctttgccgatcttattaagcagcgccagatggatgacgtgatgcccgcctgggaaattaacggccagcaaaacgtgctgccgatttatatcaatcccacggtctggtggtggcgcgccgatctgttaaaacagtatggtttcgaccaggtgccacgacgttatgacgagctgtaccggctggctgaggcccgccatgcggataacaacggctacgtgatgcagctcaccgccggaaaaaactggtgggagcgctggtacgattttattccgctgctgtacgcgcaaaacggcggcaagccctatatcgcggagaatcaggcgcagtttaataacgccgacggtcaggcggtactgagctttatgggcaaggtgttcaacagcggctggagcagctacgactttacctcagcggaagatccgctggcgagcggtcaggtgctggtgtcggcgcgcggcccctgggacatcgcccgctaccgcaaacagtttcccgagatcttaaagcagatccagattggccccatgctgacgcaaaacggcagcgaaaaaccctatacctttggcgacagcaaaggcgtggcgatgttcagcaccagcaaacacaaggccgaggcctgggcgtttttgcagtgggtgtttggcaaggcagagcacgatctgctgtggctggaaatggtcggtatgccgcccgcccgcgccgatctgctcactaatccgctgtttgtcggctacttcgcgaataacccgctggaaaaacagatcgcctcttatgtgaatgtcgcgctgcccgcggcggcgaccaccaaaaccagcgacattcagcgcagcatgacgcagatgatcgagcgggtcattttccgcaacgacgatccgtcggcggcgctcagtgattccgctcaggaaattaacggcattctcaaaccttaagaggcggcgatggctggacatgacgcacgtaccggaggctggctggcctccgcatggctcgggtattcgctgctgttctggttttatccgctggcctggctggcgctgttaagcgtgacgcagtggcagttcaccggtacgccggttttcacggggctgagcaatctgttcagcgtgatgcaggatgagctgttctggacctcgatgctcaatgtactgcgctttctgctgtggtacatcccgattgtgtttctcagcgcgctgctgttcgccgccgggttaaagcgcatcacctttggccgggggtttatcgcgctgagtttcctgctggcgaacatttcctccggcgtggcctactccattgtgttttcaaaactgttcagcgagttcggcccggtgaacgcctttttacgcgatctgttcggcatttccgtcccctggtttaccaacccggactgcgcgatgctctccattgcgctgatcgtcacctggaaattcgtcggctattacgggctgatcctttactccggcatgcttgcgatcccgcaggacatttacagcgccgcgcggctggataaaaccggccgcctgcgccaggcgtacgccatcacattgccaatgatgaacccgcaaatcgttatggtgatggtgctggcgatcaccgtggcgttcagcatctttaccgagccgtatctcatcaccggcggcggcccgctcaacagcaccaccagcccgatggtggtgatgtacgaagtggcgtttcagaagatgaaaccgagctgggcggcgaccatgtcgattatcgtcgccgcgtgcagttttctgctgatctggctgttccgcaaactctttgaaaagcacattgagatcgtctgatgaaaaaacttacccccgcgagcctgcttctccacgccgccatgttgatcctcgcgctcacctggctgtatccctttatctggatggtgatggcctccctgaaaccaacggcgcagatctacaccaccagcctgtttgccggtgacgtttcgctggcgaactaccagtttctgtttgataacagcaaccgcgccgataagccctttatgcgcacgctgtttaactcgctgttcgtgtcgctgaccatcaccttttgcgtcactgtcaccgccatgctggtgggctatgcggtggcgaagacggattttcgcggcaaaaacgccttcaaaaatctgcttatcgtgcagatggtgtttccggcgtttatgttcatcattccgcagtttattttgatgcgcgagctggggctgattaacagctacagcgcgatgatcctgccctacgccatgagcgcctgggggatctttatggtctcccagagctttaaaggcacgccgaacgactatatccatgcggccaaactcgatcgcgccagcctgtggagcattctgcgccacgtgatgatgccgctgaacaaatcgatcctcgccattgtggcgctgttcaccttttccactgcctgggacaactttctctggccgctgatcgtgatgcgcgatgccgacaaaatgccgttctcggtgctgcttgccaccttcagcaaatcctggggcattcacctcggcccggtactggcgggatccgtggtgcagatgctgccggtgatgctgctgtttattatgttccgcaaatatttcctgcaggggatgtcattgtcactcaaataaggagggccggatggaaccggtgcgctggtggcaggagtgcgtgttttatcaaatttatctgcccgcgttttgcgacggcaacggcgacgggcggggggattttatcggccttgcgcagaagatcgactatctgcatgagttagggatcggcgggatctggatcacgccgttctacccgtcgccgctggtggataacggctatgacatcagcgactactgcgcggtggatccgcgcttcgggcagtttgaggatttcaggaacgttgtggcggcctgtcatgggcgggggatgcgcgtggtgatcgatctggtgctcaaccatgtctcctcacagcacccgtggtttgtcgatgcctggaataatcccgccagccgttaccgggattattttatttttaccgaccagcccaacaactggcagtcgtttttttccggcagcgcctggatgccggagccggataccgggcagttttattaccataaattcgccccgcagcaggtggatctcaactggcagaatccgcaggtggagcaggagatctaccgggtgatggatttctggctggcagctggcgtggatggttttcgcttcgatgtgatcaactttctcactaccgacggcatcggcgcggataacctggaaagcgcaggcgaacaggaacaccggcacgatgtgaaccagccgggactcatggccgtgctgcgccgcctgatggcgtatgcccgcgccagaggcgatctgtttctgatcggcgaaatcggcagcgaggatctggcggtgctgcgccgctatcaggccgcggatctgctggacgtggtgtttaacttcaatctcggcagccagaaaaccttcagcgcggcggcgattttcgccgccttaaccgccatgaatgagcagcagccgggcctgccgacgctgtttttttccagccacgatatgtcgcgcatgatcagccgctttggggaaaacgaacgcgatactgaccgcgcccgcgccgtgctggcgctgcaactcaccgcccgcggcgtgccctttatctaccagggagaagagttcggcctgaccgattatcggccgcaatgccttgcagacatcagcgacgtgcagggcagaacgcattaccagaccgcgctggcggcgggcaaaaccgcagacgaggcgctggcaatcgcactgacgcacacccgcgacgcctcccgtgcgccgctgccctggggcgaaaaagacgcgctgtggaaggattatcgcgagctgatagccctgcgtaaccacatcccggtactgcgccacggtgcgtatacccgcctggcgttaacggatgcctgcatctggttttcccgcatcacggcggacgagcaggtgtgggtggcgattaattttggcgcgccggtgcgtaatccgtggcacgcggtggcaggcgaggtgctctacggcgataacgccccctggcttgggaaaaatcagtttgtgatcaaaaggagaggttatggaaaggcacagtaaaaatccgcttatcacgccggctgacgtggtgccgtcttcaccggagatgaaagtcgagtgcgtatttaacgccggggtgacggagtatcacggcgaagtgttgctgctggtgcgcgtggcggagagcgtgaaatgtaacgatgcaaacaagatcgtcgtgccgctgcttgagcagcagggcggggcgtgggtggcggcgacgcgggcgttcgatcgcgcggatccgcgctacgacttcagcgatccacggctgatcgtacaaaaaagcgatccgtcgcagatctggctcacctccatgtcccatttacggctggcgcgcagccgcgacggcgtgaattttagcgtcggccctcagccgtttatcctcgccgacagccagtgcgaacagtttggctgcgaagatgcgcgcatcacccgcatcgacgacgtctggtatatcaactattcggcgatttcaccgctcggcatcaccacggcgctggcaatcacccgcgattttgtgacggtggagaaaaaagggctgattttctgcccggacaaccgcgacgtctgtttctttccggaaaaggtgggcggcaagtacatggcgctgacccgcccggcgccctgtcattttggcctgccggagatctggatctgcgaatcgccggatatgctgcactggggcaaccaccggcatctgctcgggcgttccggcgatgcgtgggacgcgcgcaaatccggcggcggcgcgccgctgctgaaaaccgatcgcggctggctggaaatttatcacggcgtggatgaaaaccagcgctactgcctgggggcgttactgctggatacggacgatccgctgaagatcctcgccaaatccccggtgccgctgctggagccggtggccccctatgagcgggaaggatttttcggcaacgtggtctttacctgcggggcgttgatcagagatgagacgctgcacatctggtacggcgcagccgatgagtgtattgcgctggcgacgctgccgctggatgcgctgtggcagcatctgggggtgtgaatgtttccctcaccccgctggtatagccgggtgagggggcaaatctcacgcctccgccacgcctacccgcagcgcagccagcgccgcaccggcggctttcagcacctgctcgcactgatcaatctgtagcgtcagcggtggttcaatacgaatggttttcgaattgttcagcgtcccggccaccagtacatgctggcggaacatctcgctggcaaagttatagcccgtctcgttatccacaaactcaatggccatcagcatgcctttgccgcgcacgtcctgcaccagatccgggtattcacgcgccagcagacggaagccgtccagcagcatgtcgcctttctgctctgcctgcgccggtaagttctcttccagcagcacgttaatggtcgccagcgccgcggcacaggccagcgggttgccgccgaaggtggtggtgtgcaggaagggattatcaaacagcacggagaagacttcttcggtggcgatggtggcgccaatcggcatcacgccgccgcccagcgctttggcgagacagagaatatccggatggacattttcgtgctcgcaggcaaacattttgcccgtgcgtcccataccggtctgcacttcgtcgaagatcagcagcgcgccgaactcatcgcacagcttacgcaccgcaggcagatagccgaccggcggcaggatcacacccccttcgccctggatgggttcaaggatcaccgccgccacgtcatcgccggttttgtggcattccgacagcagcgtgcgcatggcctcgatgtcgccgaacggcacgtggcggaagcccggcagcagcggcataaagggtttgcggaaggcggatttcgccgtggccgacagcgcgcccagcgatttaccgtggaacgcgccgctggtggcgacaaaggtaaatttaccgcgcggggactgatacgctttcgccagtttcagcgccgcctcaacggattcggtgccgctgttacagaagaagctgtatttcagttttcccggcgccagcgcggcgagggttttggcgagcatcgcccgcagtggatcaagtaattcctggctgtgaaggggttgtttggcgagctgatgctgtacggcggaaacaacgactggattacggtgccccacgttaaaaataccaaagccacccaggcaatctaaaaactcctgtccctgggtgtcgacaagcgtattcagacttcccgcttgccactctacggctccgtaatccccgcctgcggtgacagattttcgatactctaaaaaccccggattgacgtgctctttaaaatattcaatcacctcgcgattcagatctttcatttcgtcatgagaaagcgtggccttctcaataatgttaagggcatgtgcgctacaggcaagagccgatgcgctggaaggtaacctgttcaaaatgagctcctgggagtggcgtatcacgcgatacacaaaataattattgcagggattacgccacttcagcaggtgcgctgaaaatcgggataaacaccaggtggaaccgcgatcgcgcaaaatttaatcgtccggcggggcgattaaactcttttcctgcggcggtaaaaagcggtctttggctgtactttcgccgatattgcgcagatatagtgcagattttgcctctttatagggcacaggcaaaaagggagtagaagtagtttcttgatgaaaatattagaaaatcaatgacctgcatggcatgaaattaacagggttttagtgcgatttgcgatctaaatcaaatttaacaactaaagataaactcattagcgccgaaataacatttgccagaaaaattaacagccagataactctgcaaaggacgctttcatgcctgctcaaccctgggtcagtcagcacgagtatttactcgatgatgacaccaccctgatgtccaccaccgatcttaacagttacatcactcatgcgaatgacacctttgtgcaggtcagcggctatgagttagatgagctgatcggccagccacataatcttgttcgtcacccggatatgccaaaagccgcgtttgcggatatgtgggccaccctgaaacgcggcgagccctggagcggcatcgtgaaaaaccgccgcaaaaacggcgatcactactgggtgcgcgccaacgccgtgccgatggtgcgcaacggcaaagtcaccggctatatgtcgatccgctcccgcgccacgccggaggagatcgccgccgtcacgccgctgtacaaggcgctgaacgaagggcgctgcaacaagcgtgtggataccggtctggtggtacgcaaaggctggctggggcgtctgcccgcgatgccgctgcgctggcgggtgcgcagcgtgatggccgggctgtggctggtgctggcggcggccatggccttgctgcatgccggctgggcggtgcagctggcggccgcgctgatcttgctcatcggctgcggcatttttgaggcgcagattgtgcgtccggtggaaaaggttgcgcagcaggcgctgaaggtggcaaccggcgagcgcaacagcgtgcagcaccttaaccgcagcgacgagctggggctgatcctgcgatccgttggccagcttggcctgatgtgccgctggctgattaacgacgtggcgcaccaggcgacagaagtgcgcgacggcagcgaaaccctggcgaaaggtaatgacgatcttaatgaacgtacgcgccagacggtagtaaacgtacagcagacggtgaccaccatggggcagatggccgcctcggtgcagaataactccgccaccgcagcggcggcggataagctctccatcgaagccagtaacgccgccagccacggcgggcgggcaatggacacggtggtgaaaaccatggatgagatcgccgacagcacccagcgtatcggctctatcacctcgctgattaacgacatcgccttccagaccaatatcctggcgctgaacgccgccgtggaggcagcgcgcgcaggggagcagggcaaaggttttgccgtggtggccggggaggtgcgtcaccttgccagccgcagcgccagcgccgccaacgatattcgcaagctgattgatgccagcgccagtaaggtgcagtccggctcgcagcaggtacacgccgcaggcgccaccatggataacattgtcgaacaggtgcagaacgtcacgcagctgattgcgcagatcagccactccacctctgagcaggcggccgggctgtcggatctgacgcgcgccgtggcggagctggataccatcacgcagaaaaatgccgggctggtggaagtgagcgcccaggtatcagcgatggtcaaacagcgcgccagccgtctggaagaggccgtcaccgtccttcattaagtcattcccctcaccgcttttctgcccgcagagaagcggttttttatcccctgatggtcttccctcctgttagcctcatgtaaattatatatttaaatattgttaattttatattaaaagccgaatgctttttgatcgaaatatatcttatttacggatcttcattaggctatttttcgaataacagcaacctgtcggagaatattcttttcgtgcggtgataaataaaaaaccgatcaaactcataaagttagcgaagccgttaccgataacgtttcctgtgcgtagccatttacaaccagggaaaaaatatgttcttacatgatgttaagatcggcacaaaattatttctggcgttcggaatttttattgtgttgatggtggtgagttccggtctgtcgctgttcagtctgaatcgtgccaacaatgggatgcaggacattgttaatcgtgactatcccacgaccgtgaaggccaatcagttgattgagaattttcaggagtttgtcagcacccagcagctgatggtgctggatacggacgggaagtggagcgccgaatcgcagaagcatctgaccgccattagcggcaacattaccgtgttgctcgacgacctcagcagcgccctgcgcgatcgcgagtcgcagcgcatcctgagtgaactgcgccagatacgccagcagtatctggattcgcgtttccgtattctcgaggcggtgaaaaataaagatactcacgcggcggtggaagagatgatgaacaacactctgccggtacagcgtgcctacaaagccaaagtgcaggagttgattgccgttcaggacaacaatatgcgcagcgccggaaagctggtggagcatgattttaaatccaaccgcaccctgctgatcctgctggcgttgatcagtattggcgctggcagcctgatggggctgtttattgtacgcgccatcacccgtccgctggtacaggcggtgcagtttgccgaagccattgctggcggcgatctgactcagcatattgacgtaaaacaccgggatgaaaccggcgtgctgctcagcgcgctggtggcgatgaaaacacgcctgtatgagattgtgcaggaagtgcagaacggctcggagaacatctccagcgccgccgcgcagattgtggccggtaaccaggatctggctgcccgcaccgaagagcaggccagttccgttgaacagaccgccgcctctatggagcagatcactgccacggtgaaaaacaccagcgaacacaccaccgaagcgacgcagctctctgccgaagcggcgacggtggtgaaaaacaacggccagatgatgaagcaggtgaccgagaaaatgcgcgtcatcaacgacacttctgaccgcatgtccgacatcatcaacctgatcgattccatcgccttccagaccaatattctggcgctcaatgcggcggtggaagcggcgcgcgccggtgagcacggacgtggctttgccgtagtggcaggggaagtacgccagctggcgggcaaaacggcgtcttccgccagtgagatccgccatctgatcgaaagctccaccgcccaggcccgcgacggcatggcgctggtggaaaaagcgggtgggctgattaacggtatggtcagcaatgtggaagagatggacaccattctgcgccagattggccacgccagccgtgaacagacggaaggcatttcgcagatcaacagcgccattggcctgattgactccaccacccagcagaacgccagcctggtggaagagtctgtggccgccgccgcgtcgctcagcgatcaggcgtcgcacctgaaaggtctggtcagcgtgttccgcgtgcgccgggaggcgacggcttaatccagctgtgaaatctccagcgccgcacggtcgatcaccgcgatgatctgttcccgctgtgcggcgctgacgttttcctgattcactttccgatccagcacggctttaaagttatccagcgcgcgtttcatctgcggatcctgacgcagcagatagccgacgctgcgggctttgatccgcgcctggatctgaccgagctgttcagcgttttccgccagccactgcgttccggctgcggtgatagcaatctttttccgtccgccgtcttccccgatcgcgataagcgcctgttcctgtaaaaaatccagcgtcggatagatcaccccggggcttggcgtgtaatgcccgagggtaagctgttcaatggccttgatcagctcgtaaccgtggctggcgttgcgggacagcagatccagaatgaccagccgcagatcgccatgcccgaaaaagcgcggacggcggctgccgtgctcgtgatgaccgtgatcctgtggatgcctcatcgcataatccctctgaattagatatatctaattttgcttgcgttcctgctaattagcaatcattatcatttaaaaaccaaatcagatatatcgtttttaacgtgacgaaggctaaataatgaccacatcacatcagcgttacccgcagcgcgtgcgcaatgaactgcgctttcgtgaactgacagtattacgagttgaacgtatcagcgcaggttttcagcgcattgtgctgggcggcgacgaactggcgggcttcagttcgcaggggtttgacgatcacaccaaagtctttttcccgcagccggggcaaaaagtggtgccgcccacggtcaccgaagacggtatcgtctggccggacggcccacgcccggcggcccgtgactatacgccgctgtatgacgcagaacgtcacgaactggcgctggatttctttatccatgacggcggcgtggccagcagctgggcgctggaggcgcgggaaggcgacaccctgaccatcggcggcccgcgcggttcgctggtggtgccggaggattacgcctggcagctttacgtctgcgatgagtccgggatgcccgcgctgcgccgccgtctggaagccatcagcaaaaccccggcgcgtccggaagtcaccgccatcgtgactattggcgatgaggcgtataaggattatctggcgcatctggacggcttcaatatcgaatggattatcggtcataacgaggacgtactggcgcaacggctggcgcaggtgcgcgtcccggcgcaggactattacctgtggatcaccggggaagggaaggtggtgaaaaacgtcagccagccgttcgaaggcggcggggttgatccgcaactgatgcgggcggcagcctactggcacgccaaataatcaggcgaccgcgtcgagctgcgcttcgctcacctggcgctccagcgcggcgcggacttcgctgagcgctttttcctgctgggtaaaataagcgtccatattgctgagtgatgacaccagcagccaggactcctctttttccagctccgccagctcggcgaccagggtgtcgatttgttcacgtacctgcgccatctttttgcggatacgttccagatcgttcagccggtcgctggccatcatcggctcaaagccctgatgcagacgcgccaccagcgagcgaatggctttgacgtcgccgcggtgtttcgcctgattaagctgcaccatcatggcgttggcttcatctttcagttcatctgccaccagatccgggtgacagagtttactggcctgacgccacagccgtttcagttcgctttgatcttcttctgacagctggcggccttttcggaaacggatctcggcgtcgtgctgctgctcgcggtatttttcgtactcgtcgtttgcctcgtcacaggcctgacgcgcgggctcttcttcccgcgttaagccggtttccagctcctgcgcttccgccagcagattggcgatcagatcgctttgctgctggagctgtttgcgcgcctcgacagattgcaccgaatcggcgggcagctcgcgccagcgttttgtgagcatcgccagcacgtccagcgcctgcgccatatactgctggcagcggcggtagtcctcttcccgacgctgccgctccgccagctggcggcgcaggttcagttccgccagatttttacgcagctgaaggatctgcgtcatcagcggcccgagacggttcagataaaggtcattaaattcatctaactgctgaacgcgggcattgcggcggtcgatcagatcgcgcagccgctcctccagcgctttgagttccagcttgctggccgccacctgcggatcccgccactgggtcaccgcgcgctggctttgcaaccaggcggtgatcgccgtcatggcggcggtgtaattcttttcctcaagcgccgcgacaatcgccagcagctcatcattgaacgcttcatttttcagccgtgcgagctgactgacaatgatgtcgtcatcttccagttctatggcatttttgatgatttcaagtcgtttgatgggtgtgctcatgatgcctttcgctttagcgcttaagtatttgagttaaggttagttatcagcagagctaccggaaatcatacacaggtctgataaatggtgcgaggggcattaggcgggtttgcggcgggtgacaggcctggcggggagttttcctgcagaaaacaaaacccaccgcagtgggttttgctgacaacccttattgcttcggaataatgagcacctggcccggataaattttgtccggatggctcagcatcggtttgttcgcttcgaagatttggttgtacttgttaggatcgccatacacctgtttggaaatggcgctcagggtgtcgccggatttcacggtgtagtaggtggcttcggcggcggagtcggtcactgagacgttattctccacgctgccaatccccgccacgttacctacggcgacctggattttttctttctgctcctgggtcaggccatcaccggtgaccacggccttgccgttttccaccttgacgctgactttatcggccccgggaacacctgtttttttgagatgctcttcaagcttagtgccgtgatcgctgtcgttgcctttcagtgaatcccataacttttcgcctgcatctttcacaaaatcaaataaacccatggtttctctccagttcaaaagaccttttaatcctggcaaaggcggcagaaagtgccagttttggttaaagaaagcagacttgcgacctggggcgcgctaaaaaatagtgcgccgtcgtgcggctatgatacaaagtacccatcattttatgtgcaagtaccagaacggatggcggcgtctgtcccgatggctcatattcaggaacacgctatgggttattccatcgacatcatctcttgtatcaccgaccgcttcgtggaactcaccaccactgaaaagcgtatcgcgcagtttattctggatgacgtacagtctgccgccacgctgccgatcgcggagatggcgcgtctgaccagtaccagccaggcgtcgatcacccgtttcgcccgcgctattggctgcaaagatgtgcgtgaactgaaggtgaaactggcgcagtcgctggcggtcggccagcgttttattatcgacgtgccggatctggaaggcgtgcagggaatttacggcaccatcattaacgtgctggagatgaaccgtcgcgcgctggatgcggcctcgctgaataaagcggtgggctggctgagcggggcgcggcagatcctggcgttcggtatggggggcggctccaccatctgcgcgcaggaactccagttccgtctgtttcgccttggcctgccggtggtgagtcagaatgacgggctgctggtgcgcatgatggcggcctcggtgtcgcctggtgacgtggtgatcgcgctgtcgctgggcggctttacgccggaggtggtggaaagcgcgggcatcgccagacagtatggcgcgaaggtaatcgccatcacgccggaagcgacgccgctggcgcagctggcggacctggtgctgccgctgattgtgcgtgaaaacgactacatctttaagccgagcacatcgcgctacgccatgctggcgatgatcgacgtgctggcgacagaattagcgatggctaacaaaagccaggcgaaagaccgcttgcgcagaattaagctggcgctggacagccatcgcggcggcgcggatcggcaaccgctgggggattaacccaccagccgattgtgtaatattccaccaagtaatggtgggacattgatgcggtgcagcagtcttcctgaaaggcctgatcgtctttggactattactttcctgtataaaacgggttgtggcagcacgtcaaaataaataatgcaattaataactaatgcaaatgaatattaactgtcaggataataaatacagcgatggtatttgttttatgaatatattaacggaagtaatgattacctaaatatattcctaaaaacacgcggctggctctttttgtagagaacttttaatttcatcaatttttctaatcttttgttttaatatgttgtttttccagcatttttgcggccattgcttgtgttgatttgaactaaaataaactatatcatataaataatatcactcgtcctatcgagcaatcatcatttctaatattgcaataacgatagcttcatctaataatcccctccaggcacaataagcatctcattttatcagtgcagtgaagcgttgtgcttttgtatacccgacataatgcacggaagtgtatgtgaactaacatataatggagttatgaattatgcgacattcagttattaagatggctcagattgctgtgctggttgctggtggtttggggacagtaaatgcgatggctgctgatggccaaattcgtattaccggtgaagtcattaataaaacttgcacagtagcaatcaacggcgcgccgtcttctacattgttgaatatcgatccggttgctgccgtcgatctgaataaagatgttaagtccgctaaaggcacgacttataaagcatctcgtgatatgcgtaccgtaaatattactctggaaagctgcgtcctgcctcaggggaaaactaaagttgcggtcagttttgattctactggctatgcggatgcgggcaccagcacctatacaaatagcctgctgaattctgtgaataccatggatgttgccgcgaaaggcatccagatcggtttcactaaaattaatggcagcgatctgatgatggatttgaacggcctggatgatactgcagattataaagacaccaattcaggtgcgcagacctacagtttcgaaactcgctacgttcagacggctgctaaagcagaagatgtcaccgccggtgatatcgaaacggtagccactttcagcgtcgtttatttgtaattatttactaaatctaaggcggtaagtcttattgccgccttgttttttcagagagcaataaattaaatgtcagttaaatatttagctacaattgtggcagcgatgctggccgtgagcgcatcagcatgggcagatgttgtcattaataccactcgagtggtctataaagaagcggccaaagaagttaacgttcgcctgactaacgagggcacgcgtccgctactggtgcagtcatggctggatgatggccgtgcgaccgaatcgccggaaaatattgatctgccttttatgatcacaccgccggtctcacgcattgatgcgaaaaaagggcagacgttacgtatttccaaaatggccgccaattttcccaaagatcgtgaaagcatctactatttaaacgtgctggaagttccgccaaaagcaaaaggcgaggcacaagcgagcaacaaattacagctggcattccgtacccgtattaagatgttctatcgtccagaggcgttaaccgtcaaaccacaagacgcggcggcgaaagttgaatggcgtgctgaaaatggtgcgttaattgcaaaaaacaactccccttattatgtgacgttcaacatgatgaaagtcggtaataatatggcgaagtcaggaatggttgcgccttttgcaacggaaaaattcgagtttgataacaaagcatttaaaccttctgcgggagccagcctggcctatagctatatttctgattatggtaatgatgtagagggtactgctgttatcaaataatatttcaattacaatggattgttcaggttttttctatggatatgttagttagcgaacgttttcgtttatcacgtattgctggcgcattcattttaatgaatgttgccggaggagttttcgctgcggaaacggaaacagttgagcaaaatagtctctcacctgcatcatcagtagaaaattcgaatgcgcagcaagagggtgaaagtaaagaaagtgaaatagcgggaactgaagatgaagaggtggaattcaataacatctttttatcaaattccccaattgatgtaagccgtttttccaaaggaaaccctgtcactgccgggaagtataatgtttcggttgtacttaacgagcgggaaatggggaaatttgaaattcaatttgatgataacccgcaagatccgttaagagcgctgccctgctttcgcctgaaagaactggctaagcttggcattgatattggcgcaattaatgtctctggcatggaagaagaaaactgcgtttcgctgaagacgctgataccacaagccagctggaaaatggatattaacgatcagcgttttattctgactattccacaagcgatggaacgggcaacccgccctgatgaagtgccggatacgctctgggacgatggcatcaacgcggcctttgtcagctataacaccagttattatcgctcgagctatagcggcgttgagtccgacagcggttggatgggcctggatggcggtctgaatttactggggtggcgtgtccgtgtccgtggcgatgcgaactacgcaaaagagagtggcaccacgtttgacagttcaaacctgtacgcggagcatgatgttgcaccgcttaaatctcagttgcgggtaggtgagatatacagcagcagcacattttttgatgcgtttccattacgcggcgtgacgctgagcagcgacacgcgcatgttgcccgactctctgaacagcttccgcccggttattcgtggggtcgcggagtcgaatgcgaaaattatcgtcagtcaggcaggcactaaaatattagaaactaccgtgccgcccggggcgttttcgatcgataactataatccgatcagctccagcgaacagcttgacgtcacgatccaggaagcggatggccggacgcgtcagctaattatcccatacaacggcggtgggcaattgctttacccgggcgtcagcctgtacacgctggcggtgggggaatatgacggcgcgagcagtagcgataaaccggtggtcggccagggtacctggcaatacggtctgaataactatctgtcattgtatactggtgctgaatatatgtcggactactactccgttattggcggggtggcgctgaatacgccggttggcgcagtttctttagatttgactcagtcgcatttgtcagcagaagacggcagccggaaagggcagagtctggggattaaatacaacagctatattactccgacgaataccagttttaatatcgcggcttatcgttattcgacaaaagatttcttcacgctgggtgaggcggcagattatctgtcgaataccgactggcaggacatggacgatcggcttaaatcacaggtgcagattaacgttagccagaccctcgaagcgggatggggctcgttttattcttcagcaatgttatcggagtactggcgttcagggcgtaaagagaaaagctatcaactgggatacagcaactccctgggccgggtcagctatagcgtttccgttaaccgctattacaccggcgataacgagaaggacgatcagctctatctgtcgttatctgtaccgctcggcgatcgcgccgaggataaatcgccgctgtttgattatctgaacaccagttatacccgtagcagtaagggagaccgcaatttatcggcttcgacttcaggttataaccaggacgcgggtctgaactacggcgtcaatgcgaattatcgtcagaacggctatgacgggaataagattgagaatatcggggcgaatgcttcgtgggatacccgttatggtagctggggggccagtctttctgccgatacagagaacagccgccagatgtcggtgagcggcagcggtggcgttttactccacaagggaggaataaccctcgggcgcaccatcaatggtgacacgcctgttgcattaatcgaggcgaaaggtgcgaagggcgcgcgtgcaatgggggataacgcgtcgcgaattaatagtgccggctatgcctatgtctctaacctgtcgccctatcgttttaatgatgtgagtatcgatccctcgaaaatggaacaggatacggaattaaaagagacgtccacccgggtggtgccgcgtgccggagcagttatttatgtcccctttgccacggacgatcgtcgctcggtatttttccacctgaagttgaaaaatggcaaaaatattccgctgggggcagaggtggtcgatgattcgaataatcagttaggtatcgctggacaaaatagtcgaatattcacccgtggcattgctgaaaaagggcgtttaactgtcaaatggggtgaagatatgagtgaacagtgttcttttaattaccagttacctaccagggacgatattaagttacgaacagatacgttatcagtcgataatattaattgtgattagttattatagaaaaggagagctatatgtttttaaacaataaacagacagtaagggtgcttactgttatggctggagttatggggttcggacatcaggcgatggccgcaacgagtacgctggatgtaactgctcaggcatatattgaaaaaggtacctgtacgtttaaagtggataatcagtccgccacgagcgttccttttgcctttaataccgtcacaccagcagagattgaagcgcaaaataaatcagttgaaaagaaaattgtcatctcagattgtgtgggaacgtcgggaatgaacatttccctgtcgtcatcaaataaagttaaaatcaatggcgataccacacatgactacctccgcccagctaatgtggcggtgaaggtagcatataaaacggaagttaaaaccgagggtggtaactatgttccgctctatgttggggcaccatcaatcagattgggtggcaatttcgagccatttggacaaggtaaaacgggtaacctgtatattaaagccacgctgatccctgcagtggctgatattatgacaattggttctggaacactggactcaacagcaacgcttaacatggactttttataattaaggatgattatgatgaaaaaagtactggtacctttaatttttttggcaccttttgccgcccatgctcttaatgacgctagcctgacacttaattttaccggaacgttaactttaccaacctgcacagcgaaatttgatactaatgcgaccagctttaatatcgactttggtaacgtaaagagtagtgacgtcctggcttcggcaagccatgggggttatctggtacccaatacagtctataaaccagttaaagtaaaatttaccgcatgtggtgcatcaacaaagtttgttgtgggtctgtcctccgctaaaaataacactgacggtacaaattataagaataagtcgcttaaaatgttcacttctgcggcgacaccagctgcgaccgggttaggcgtggccttctttaaaactaatcaagacacctcggaaacgaataccctgccaaccaacggctcgaccgtgagtatggctttctctggtaacacgacgggcgatgccaccaacggttatgtatggacaacctatgcaggattagtggcaattgatagtgctaagctgacgtcagcggccatttctgggtatgctggcaccacgctgaaaacggatggcgcaataaatatcgactatctgtaattaagatacgcggagcctgtttaaagctccgcgtattgatagcatggacagcgttataagttgatggaggaacccatgacaaaaaatgcatcattattatacttgttgatttgtggaatgagcatgtgcggttttcctcattcagccatggcggatgataaggttgatgcagccaatatggggctgcagtttagtggggagctaattaacacttcctgcacagtaacgtttcccagggatacgctaataatggaggccgtggggatcgataaatttacgcagcccggaatgacctcagcctataagcaaaattttcagctcatcattaataattgcaatctgtcacctgccgttgtcagtgatatacgactttcctttagtaccctcgatggtcagggccgtgttgcccccggagcgtttagtaatcaacttccgggtggggccaaaggcattgggtttgcggtctatgaccagcgtgataatcaaaatgtattaacggtttcgggagaaagcagagtgttaaactatccggttaatagtagcgctccgctggatattccgcgtgatttttacattaaatatatacaatccggggccgatgtcaccgctgggcagatctctgcaacattgttagtgagtgcattttatgactagtcaaatttatgacaataacggcctaaaaaagcacatcatatttattctaatggctaggatgaaaatgaaactcaaatggtttttacctgttttactttatctgtttaccgggcattgtctggctgctttgcagacgacatatataatggatgcctcttttgctggtcaatccgatttatcaatagcggcaacgttcaatgtcgatagcgcttccatcccgaatatgggcgggggggtgaaagttatgcaggagaaacaacttcctcctcctaccacgggaattgaatataatcaacgctctttatggggtgaccgcggtaatggaacctggcgctgggcaagcagttccccacttttgactgcgtcctatgacagtaacaatgttgataccactcaaaccaggactgttgatggtaaaacttattataaattaagaatggctgacagcgagagatttcctgtttacgtacggcttgaacagaaagtcttcttgcctgtaaagaacgcttattcttatgtcgatctgaaggacgtagagaatcaatctagacaacatcggggctctttcttttttaacaccattttccagaatagttatcttagtggatgtaataacgcgcagggaaacttcagtgtcactcttatttgtgtacgagatttgtattacgaattaagttcgcaattcgcgaaccgcgatgtgaaaatgtatttttacatgcccaaaaccccgttatatcccattaattttgacaatattttcgtaggttctgtcagttttagtcgcgtatgtatggttgctactggtggagacgaaagcgctgcttttatagcggccaataattgtacaatgaattccaaaaaagccgtcgtatccagattttatctgaatggttcattaatattcagaaacacctgtaaagtgactgaaaccactaagaacgttgtgttagcggatattaccgaagctaagctggcgggcaaagcacaaggtgctttacccgaagggtatgcgcctaaagaaacaaaggtgtcaatgaagtgttctggcaatatcaataattcttttcctgatggggcgggtattgtgcaggcgacaatgatgggggcagggtacagttttgacgctgacctcgcatcgaagggcattttgctggcgaagggggtggggaccatcattaacgacctgggcgttaaaattactcaggatgccgcaggccagtctctggtgaaactggatggtgtctcccccctgagggcgacaattaacaacgatatggctacggtgacattttattcttatcccacccctgcccggacaggggtcaatccaacaggtgcaggaggctatgaagcatcggctacgatgacctttgagatgccttgatagcgcagtcagtcccggctccagccggggctgacgtttatgaagggatctgctccggattaatctaaaaaagacctgcaacggagcagaacctttagccccggtcagcccggtagcaggtcacatccacttcgactttgcaatccaccaccagatccgccacgcagcacacgcgggcgggcgggtgttcgccgaagaattcgcggaacactttgttaaatgactggaagtagcgggcatccgtcaggaaaaccttcacatgcaccacgtcggccagggtgtaaccggcttcggtcatgatgtccacgcagttctggatcgccagacgggactgctcaatgatgccgccttccaccacttcgccgtctttcatcggcgtctggccggaaacatacagccagcccgccgcttccaccgctttggcaaacggcaaatgctgcccgcccgtgccggtgctgccaccgacgccataacgtctaatactcatttttgctccttatttggtttttcccggcgcagaaaacgccctgcgcggccagtgacctgctggtcctgaccataactcattaccccattcaccatcaccgcttcaataccggcggcgggctgtttgggatcgctgaaactggccacatcccgcacggtggccggatcgaacaataccagatccgcataatagccgcgtttgaccagcccacgttcgggcagccggaaacgggccgccgacaggccggtcatcttgtgcaccgccacggtgagcgggaacagcttttcgtcgcggctgtaatggccgagcacgcgggggaaggcgccccataaacgcggatgcggcatcggatcgttcggcagaccgtcagagcctatcatggtcaccggatagcgcagcacgcggcgcacatcctgctcgtccatgttgtagtaaatggccccggcaggcatcagtaatttgcccgcgtcatgcagcgacatcgaccagctttcggcgatctgcttaagcgactgcccggccacctccggatgcggttcagaccaggtgatgatgatgtcgaactcgtcggtgatctgcttcatgtccagcgtggacgaggaggcggagtaggggtagcagtcacaggcaacctcctgctgctggcgcacggtgtcgaacagcttcagcgtctccacagtgcgcccccagttttttgccccggcgcatttatggtgcgacaccaccaccggcaccctgccgtggcgaccgatacgaaacgcctcgtccagcgcctccagaatgggttcaaattccgaacgcagatgagtggtatagatgccgttttccgccgccagctcctccgccagcgccatcacttcttcagtggtggactggaaggcgctggcgtaggccagcccggtgctgaggcccagcgcgccctgcgacagcgcctctttgagctgcgcgcgcataccggcgatttcctccgccgtggccgcgcggaacagatcgtccatatgattgttgcgcagggcggtgtggccgatcagcgtgccgacgttaatcgccgggcgcgcctgcgcaatcgcctgcgcgtaggcgtccaccgtcgggaagacaaactgctgcgcctcgccgagcaggttcattggatcgggtacttcgccgtgcatggtcgcgcaggcggcgctgatcccgcagttgccgacgatcaccgtggtcacgccctggctgattttcggtaaataagcaggcatgcggataacattgatgtcgtcatgggtgtggacatcgataaatcccggcgccagtacgcgctcgctgccgtcgatttcccgcacggcgtggccttcgatagccggcgcaatctctgcgatgcgatcgcctttgatcgccacatccgcccggtactctgcgccgcctgatccatcgataaccgtgacattcctgaacagatagtcgaacttcatgtgatcctcaccccccttttggtctgcgctgaagttaaccatttacaagggataaaaacagtggaaaatgacacaaaacgcatatgaatttatgatacttttattcactatcggtggttttaaattaatacttgtttaaattacagtaagttataaaagatacccgatctgaaagatactgattcccctgaggagcgttgttatgaaataccagaatgaacacctcgtaccccataaagccgccctgatgtttaccccggccaacgtcctgaatgaggatgtctgcctgcccgcagcgctgatcaaaaaaaccgccctggagaacaatattcagtggatgcaggattacgccgacgcgcgcggcgtttctcttgcgcctcacggtaaaaccaccatgacgccgtggatctttcagcggcaacaacaggcgggcgcctgggcgattggcgtcggcagtgcgtggcaggccagcatcgccatggcgagcggcatcaggcgcgtgctgatggtgaatcaactggtggggaaggcgaacatgacgctgatctcacagttgaagaacacctatccggatgtggactatctgtgttgtgtggacagcgcggccaatgcgcaggtgctttccgcgtttttcagcgcgcagcagcagacgctggacgtactgattgagctgggcgtgccggggggccgctgcggctgccgtaccgcggatgaagcgctggcgttggccgctacggtggcggatctgccggggctgcgcttgcgcgggctggagctgtatgaaggcgtggtgcacggcgataatccacagccgcaggtggaagctttcctgcgcgaggcggcggcgctggcctgccagctggagcgctatgtcgacggtgaattcctgctcaccggcgcgggctcggtgtggtacgacgtggtctgtaacgtctggctggcggcaaaaaaaccggcggactgccgcatcgccattcggcccggctgctatatcacccatgatggtggaatttatcacaaggcgcagcatgcgctgatggcgcgcgactgcgttgcctgcgatctgggcggcgatctgacctgtgcgatggagctggcggccatggtgcagtcggtaccggaagcagggcgggctatcgtcaacttcggcaagcgcgacagcgcctttgacgccggactgccgcagccgatcgcccattaccggcagggtaaagcgctggctgatccttcagcattgatcgaaaccaccggcataatggatcagcacgccatgctgacactccggcccggcgcagaggtgcaggtgggggatattctgctgttcagtacctcgcacccgtgcctgacgttcgataaatggaaaacgctgctgctggtggacgatgagtacaacgtgctggaagaactggataccgaattctgacaggcgttccctctcccgtccgggagaggggaaatgcgcttagctgctggcctgcgccgcttctctggctttttcttccgcctgttgatggcgctcggtttccagcatctttttctcgtacaccttaaagaacgggtagtagatggcaagggagataaagaagcagacaaacaccagtccgcaggcgattaaattccagttcgtggtgatcagcgccccgagcggggccggaacggtaaagggcggtttaaccatcatgcgcgggatcaggccgctgatggtgcagagatagaccaccagcgtgtttgccatcggcgccaggataaagggaatggccagcagagggttcatcacaatgggcgcgccaaaaatcatcggttcattgatattaaacaagccgggaatgaaggaaatttttcccagctgtttcaggtaaattacccgcgagcggataaataacaccaccagcgccagcgtcgaaccggtgccgcccatctgcgcataccactggaagaactgctcggtgaaaatattcggcaggtcataagcactgacgccggactggaacagctccatattctgcacaatggcctgatcccacagcgggcggatcagcggccccatcaccgcatgaccatgaatacccagcacccagaacaggtcgatcataaactgcgtgacgatgccgccaaacagattcgtgccggtcataaagcctttcagcggcataatgagatagctgatgatggcgttaatatcgatattaaaaaagtgccgtgggatccagaataccagcaccacggcaagcgtcgggaatagtgcagagaatgaactcgccaccaccggcggcaccccggcgggcattttgatttcgatattgcgcactttaataaaacggtaaatctcaatggcgatcagcgatgagataatcgccccgaacagcccctgagagctgagcgaacttaatggaatataccgtccggtaaccgcatccccggcgacggtgaccccctgtttaatattgaccggcacgatcatcaggatggtcgccagcatcgccagcagaccgctggtaatatcgttgagcttataactttttcccaggaaagagccgatggtaaaggcggcatagagcgacatcagcccgacggtaaaacgaaacggaacatccagcatatcgcgccagggcgcgacaaaatccatatagcccttgatggggatattcagcaaaatcacaaagaatgagccgacaatggtcagcggcagaatggaaataagcccgttgcggatcgcctgcatatgccgctgattaccaatggcgttcgccagcggtaataacttttctgccagagtatcaaaagccgacatggtcactctcctcaaagccattattttcaattaccgtgcggaaccagcggcctgactttttcagcgagcgctgcccgctggctaaatccagacgataaaagccgtagcggtttttataggcattctgccaggaccagcagtcgataaaggtccacatgtgatagccgagacactggcttccgtcggcaatggccttatgcagccaggtaagatgttcctcaagaaaggcaatgcggtaatcgtcctgcacttcgccattcaccataaactgctcttcgtccatgatgccgattccattttccgagacgaaccacggaatattgccgtagcgatcctttatcagcattgcgatgtcatacagcgcgggaggatagatttcgatgccgcgggaagtattcatccggcggcctggcatgatgtattcctcaaagaagcgttcagggacaaaatcctgcgcttcggcaaggggcgtttcgcgggcttttacccgacgcgggcgataataattaattcccagcagatcgatacgcgtcgccgcaattaattcgctatcgcccggtaaagccacggggagctgattgtgttcgttgaggatggcgagcaattccggcggatagcggcccagtaatatcggctcgttaatactgcgggtataaaacagatccgccatcaccgccgcctgccgatcgtccgggctgtcgctgcggggatacaccggaatgacatccataataatgccaatttttcccggcagatttcttttacgccaggccgccaccgctttgcagtgggcaataacgatatggtgcagcacctgggctgcgcgacgaaaatcgctgacgtaaggataatggcggggatgaagataacccgcttctgccggaataaggggctcattaaaagtaaaccagtagcgcacccgatcgccaaacagctgatagcagatgtcggcgtaacgggcgaaggcctccactacatcacgattttcaaaaccgcctttttcctgcaatgccattggcatatcgaagtgataaagattaataaagggctcaatgccctggtcaatgagttcattaataacctggttatagaactcaaccgcgaggggattaatgtcgccatccccgtcaggtattaatcgtgaccaggaaatagaggtgcgaaaggagttgaggccaatatctttcgcgcgctgaatatcgtcccgccagtgctgataaaacccggaggtatcgtcggcggtgacgccgttataaaaacgctcgttatagtaatgcgaggcataatcccagatattgtcgcctttgcggtcgccgggtaagcgcccttcggactgggtggcgctggtcgccgtgccccaccagaatttatcaggaaagcggtatttcatgggcgatccttattttaccagtgacagggcgtgatcgaggactttatccccctgcatcgatccatattgcatcatatcgatagcatccaccggcacgccgtgcgtggcggcggcagcccgtaaactctgcaactggaacttcacctgcggccccagcaaaatcacgtcggcttccgtgacgatctgttcaaagtccgaaacgggaaccgcggtaatttccacttctacgttacgactgctggcggactgtttcattttttccactaacatgctggtagacataccggcagcacagcataagaagatctttttcattgcttttccctcagtgaataaacgccagaatgcgcgacgcgcggtggaaggtattctgggtagtgaccaaaaaacccacaagtgaggggggacacaaatcaggagttatagtctgatactttttgggggattggtgggtgtttggggggatagccgtttaaaatcaggggggtaggggtgttacttatatgaacggtaaaactttatcgtctgaaaacaaaaaggagtcagatgattttcatctaactccttgtttaacctggtggcccctgctggacttgaaccagcgaccaagcgattatgagttcctgccggaacaaccgaaaatcaatgttttgcgttatttatcattgacatagattgccgttgtttgccagtaactgccttcttccgccatctttatcgccattttatcgccatttgattagtaacttgagtcgatgaatcggtagtatccgaaaccagatttaagatgcagctcagagagcaaagctgacaaatcagcaggttctgatacttctactgactctgtacactcgtttctgatatccttggattcaagccaatatatatagccaactctttcataatattcttccatatcaaaatcatttccgtactttgataaaaaagcctgaatatacagaaggatggttcttgttgctcgttgaatcaaaaaatataatgttttccagttatcacctgtaaaaccatactctgggttaagatttatagggattaccccatgtgcgatgtcatttcttatatttcgaataatattgagggcatagcaacggtgttctttagggtaacttaatttattattcacttttttgttataaagcgaggtgtatcgttcgaataaagtgcataagttttgattgtaatgttcgaaatgttttggtaaatgcttttcctcaattttatcaaataaaatcagagatttcatactgttgtctctgacagggttcttgaaggatgtatttagctcattagtaaagaaggttgatacaaacctatagacttcttctaaagcattgcaaacgaagaaaagtctagttaactctgtggtataggcactaaagtatttcctgtcagactctaatgcttcgtaatgcggacggcacattattgataatgaacttctatcatgcaaataaggatttatttctacattatcaagagttgaagatagagttaaccactgattcattgcaagaaagtttgatctatgatctccgtagaagcattccgtcaaaatagctaattcatgcaggtggctttttatttccgttaaggaatgacataaagagcaatttttatctttcatctaaagtccctgattcaaagagcttaaaggatttagttttactgcatcttcgagatggtcgggggcaaagtgcgcatatcgcattgtcatttttatgtcggtatgaccgagtacgcgctgcaagaccaaaatattaccaccattcatcataaagtggctggcgaaggtatggcgcaaaacatgggtaagttgtcctgccggtagttcgatgcctgttctttccagagcagaccggaacgcgccataacaatcactaaacaaccggccttttttatcatcaggtagagactcatagagctctttgctgattgggacggtgcggttttttctgcctttagtgttggtgtatgtgattttgtatttcgcgagttggctttttctcagactctcagcctcagaccaccgtgcgccagtggcgagacagattcttaccacggtttctaaatcagggtggtcatgccgtttacactcaccgagcagttgcgcaatctggtcgtgagttagccaggccatttccatttcttctgtgcggaatgggcgcatatttttcagtgggttttcacccttccattctccgagacggtttagctcattgaacaccgcccggaagtaggccagctcaagattaagtgtgcgaggcgatacctctttcactctgtttgaacgagcatactcaccttttaaccgtttttctcggtagcgggaaaacatctgcgcatcgaaatcgcgtgcgggtggttcgcccatacactcaaaagcatggtgcatggctaactggcgtttcaagccgtctttcagggtaatgccatgagcgctataccatgaatcaaccagctcttttaacgtgcgcctgtcttccttttcttcctgccacgggttttgaacggtgtattgctcaaacgccagagcctcgcccttagtagcgaatttctttctgatacgtttgccttttgcgccgtttgggtagagttcacaaatccaaccgccagccggatttttacggacggtcatcagttaacctcgctgtatacacccaccacacgccccaacgctttaatatcatcaatgccgcattcgaaaggaaccttcccgcctgcaacatgtagttttctgcccggtagttttgttaactctcgaatgcttattgctccctcaatgtcgactagccataggccgtcagacaatgacgcttgcttgtccacaaaataaattttcccctcggaacggatagccatcccatctgtgagtggttttgtgaaaaattgggcatcaatgctcagttgcttatcggatttgaggatttcttcacttaatgtgaacccctcaatccttttagcgtcgctagattctctgttatttacaaacgcttccccttctccggtaagtaaccaccgaagattagcacctgtttcaagggcgcagtgagccgcaaagtcataggagatagcgcctcgggtgtacctatttgacaatgaactggatgcgatatcgaagtggttagctaattgaattttctgtgaaaatccatacgcctcgcagatgcggtcaagtacatctacgttgctccatcctaaagaatctattctcatttcgataaaacctatttactatctctcaattgggagatatattttggctaaacccacgcaattgatggcaagtgttggcaaacagagtcaaatcaattgcaaactttggctaatagggaatcatgcaatatggcttctgaaatcgcaatcatcaaagtgcctgcacctatcgttactctgcagcaattcgcagagcttgagggtgtatctgaacgtaccgcttaccgctggacaaccggcgacaacccttgtgtaccaatcgaaccccgcaccatccgtaaaggctgcaagaaagcaggtggcccgattcgcatttattacgcacgctggaaagaagagcagttgcgtaaagcgttgggtcattcccgttttcaactcgtcatcggcgcttaattcactttatgtgaattttaaggatgcaacatgtttgattttcaggtttccaaacatccccactatgacgaagcgtgccgggcttttgcgcagcgtcacaacatggcgaagctggccgagcgtgcgggtatgaacgttcaaacgttacgtaacaagctaaacccggaacagccgcaccagttcacgccgcctgaattgtggctactgactgacctgaccgaagactcaactctcgttgatggctttctggctcagattcattgcctgccatgtgtgccggttaatgaactggctaaagacaaattgcaggcctatgtcatgcgcgcaatgcgtgagctcggcgaactggcgagcggcgcggtatctgatgaacgtctgacctctgcccgtaagcacaacatgattgaaagcgttaatgctggcattcgcatgttgtcattgtcggcactggcgctgcatgcgcgtctgcagactaatcccgctatgacaagcgtggtcgataccatgagcggtattggcgcgtcattcggtctgatttgaggtgcttatgctgaaaagtgaaccgtcattcgcgtcgctgctagtaaagcaaagtcacggcatgcactacggtcacggctggatcgcaggtaaggacggcaagcgctggcacccgagccgctcacaggctgatttactggctggcctctccactcaaaagcagggggaatcatggctatcgaagctgtttccgcgactgttccgctgaaagcgggtgaacgtctggccggtctcaatcatgtagctgaattgcgcgcgagatattggggcgatagctggaaagaggtcgagcgttttgtcgatgatatgcgcgataaacgcgatccacaatttgaagaaaataatcgggcgctggccgctattttctttctggcaaaaataccggcggctcgtcatgagctcgaattaagtgagctgactactgacgagaaaaaagcgcttattacagcgatgaatcattttcgtgcagtagtgagcttatttccaaaacggctaaccatgccgaattaatacaaacagaaatttaatggcgtaaacccgccgggcttcttattgcccgaaatcaggagagtcaattatgagtaataccgaaacccgtagttttaacactgatagtgatgcgctggccgtattgctgaccgatgccaaaaaagaagagcgcaaagaccgcgcgctcgctgtttccatccgccttgaggcgctggctatccatatcaccaaagagggtatgagcggcaccgaagccgctgaactgctgcgccgtgaagccacacgctttgagaacgaatcacaggagctgcactaatggccgacgcaatggatttagcacaactgcgcgagcaggaagaccgagaacgccatatcagcaacgcgcgcagccgtatcgctgcaccttcccgttttctttgcgaggaatgtgacgcaccaatcccggaagctcgccgcattgcgattccgggtgtggccttttgcgtgacctgccagcaaatcgccgaactcaaatcaaaacactataggggcgtgtaaatgagcattcgaatcgaaataggtgataaatggattattaccagcgaccaatatcaattcatcctgaatgaaaagaaagtcgttaagtcaggtaaaaaagctggcgaggaatggcttgatactatcggctattacccaaagattaaccaacttatttccggtctggttcatcaccatattcaaaatgcaacgattaattctattagtgaaatggctgcggaaatagagagagttggcgctatctgctctgcggaatttaagggggaaaaatgagccagtcagctactgtaatttctgtttctgatatttcggagaaggtcagggaaatcgaaatagcataccaccgctatttgaatttattccgtatacccgatgaccataaaatagtcgtgaattattctgccggtaaagacagcactgcgactcttgctgtcgctaatgcactgttcggaaaccgtgtacaagctgtaatggcggacactgataacgagcatgagttgactgttgaatttgctcgcaacgtccatcagcaaattggctgcaacccagtgcaggtagttaagcgggtttacacagaggctgactttgctaaacgccgtgcatatatggagaaaaactggcgaaagcgtcaggcaatccgtatgggagtgtatcgtggaattgtgatgccgtcccttgctcgcgcggacactaaattcggtcaggcgtggttacgtaccgctgaacggtggggaattgaatttgaaacacctctcgacgcggcactttcagttttacatccatcaggaaacagcttcttggactgcgcattgcttcacggcaagtttccaatgctgcgcgaccgtttctgcactgatgaactgaaaattcaaatcgcttatgaaaaagcaatgctgccaatgctggacgatggtgatgttgttgttcaatggtctggtgtgcgagccgatgagtcatcaaagcgagctggttatgagcgtttcgctcccgaccgacgagacccagaatttttatataactttctacctatccatcagtggacagcagccgatgtttttgcgctgcataaatattttggtattaagccaaacccactatacatgcagggagcttcgcgtgttggctgcatgaactgtgttcttagcaataaagaagaaattgccgagacagcggcgcgctggccagaacacatcgagaagcacaagcaatgggaactaaaagttcgcctgaccagccgctgggtacactggatgagtgttggagaagttagccagcgctggatgaagcagtttgatttacctcttggcctcaatgttcagatgttaggtattacaccagaagtccagaacatcgattggtcgggattctatggcccgcgcggggggcttaattcacctagcgttggcgatgttgttgaatgggctaaaactggccgcggcggaaaggtttatgacctcgttaaagccagtcttgatacggctacttgctcctcgcgctacggcctgtgcgaatgagctccatttcttatgcctacccgtggaacactccacggtcggcaatagccagcccatatattacctatgagcaacagtatcgccgcgaccgtatgttcgcggctttgctgcatgcgagaaaggtgctttctctccagcccgagtgcgtgcgttttgacgtttatcgcaccgctgctgtgctggagcaaaatcatggcagtcaacgagccaatgcctttttaatcagcttctgcaaaaaggcattgccacgtctcgagctggtcgcaaaaaaatacgagtgtgcaggtatcaaaagcaacgtatcagtcgctgtttttggcggtcattttgataccgagcttatgcagtatctggcgtcacgcatggtcaatatggttgccagatataaccgcctccctgatatgtcgcgcgccgatatcgaccttttggccgctgatatcgcaaatttcattcgtgctgaactggccgacattgatgacaccggatttagcgagctcaaaacgctgtacacctggtacatgcgagccggtttcatttccctgcaattcaatgttaccccgccgcattgggagcgggtgacaaagaaatatgtcggtgaggatgaaatcgcccctgctatcacccgcatgtttaatgaggtttggtggcgtggccgcttgcgacgcattgcggctgcatggcgcgaacatctgcagatcgcagtcggcaatgtcagcaaaaaacgacacgcatatgcgagtaaaaactgcgtgaccgactggcgcgagcagaagcgccgcacgcgagaatttctcaaggggctggatctcgaagacgaagacggcaaccgcatcagcctgattgaaaaatatgatggctcggtcgccaaccctgcggtacgtcgctgcgagctgatgacccgcatccgtgggtttgaaaatatctgcaatgacctcggatacgttggggagttttacaccctgactgctccgtctaaatatcacgccacgactaaagcgggataccgtaacagcaaatggaacggagccagcccatcggatacgcaaagttatctaaccggcctttgggcgcgcattcgcgccaagctacaccgggaagaaatccgcatcttcggcatacgtgttgccgagcctcatcacgacggaacgccgcattggcacatgcttatgttcatgttgccggaagacgtcgagcgcgtgcgcctcatcatccgtgattatgcgtgggaggaagacctctacgaactgagaagcgataaagctaaaaaagcgcgctttcatgccgaggccattgacccggaaaaggggagtgctaccggctatgttgctaaatacatttccaaaaacatcgacggctatgctcttgatggtgaaaccgatgacgaaagcggcgagctgctgaaagagacagcccctgccgtttcggcatgggcggcacgctggcacattcgtcagtttcagtttatcggcggtgcgccagtgacggtctatcgtgaattgcgccgcctcgctgacaccgagaccgcacatggtctgagcgttgagtttgctgccgtccatgatgccgccgacgctggtgactgggctggttacgttaatgcgcagggtgggccgtttgtccgtcgtgctgatttgcaggtgcgcacactgtatgaaccgcgcgccgagtttaatcagtatggcgaggaaaccgtctgcatccgtggtgtctacgactctattgtcggcgctggcaccccgattttaacccggctaacgcagtggaaaattgtgccgaagcgtgccgttgatttggccgttgacgttaagggcgctcctgcgccctctcggagttctgtcaataactgtacggcaagcgaaagcgatccaccgttactggatttaacaaaaccgctgagtcggcgtgaaagacgagagctgacgaaccgactaaggaagcaaaggccagcaatacggcgaagattcttccacggcacggatgagcagaacgcagctataaagaaaactatcgatgagatacatctgacaaccggcattaatatcagtcggggcgaagccctgcacctgatggccggtggtaaaagttgtcttgatggcaaatggctacgcggaacgggtaaaggagagattttttccgcagcaccatcccatcaggctaaagctaggaaagttctcgatcgtgtagcggctttagcggaaatggcaacgaaagagtaagcggcaatgttcatccatatcatgtacatacagtatattcctatgcgattttttcttcacaacatttgtcgatccgtggtactgtatgtttatacagtatctcgttgtggaggttgtgtggatagagagttgatagaacacgtcatgatcgaacgtgtcgaaatgattgcgcgtctgacggctgatggtagttgtcaggaaagagatcgtgaaattgcattgaatttaattgcggagatagcaagagggaacttgatgaaaaataataatttctctgtagttttcgcagagccgcctgttgataagccttttgcaagggagggcaaagtgaaagttaatatcactttagataaagaccaacaaatcggccagctgattttagatgcttttcagcgtgagtaatccatgcggatacaatctgtttttccgtcaacacgtgttacggtaaaaaagggatccataaccggtattgagctgatgggtttcgatacagattctgaccgcgcagcagttgatagtattcttcaggaggtatgggaagatgagagttagcggtgatcttgtaagaattaagcaataatagaaaaagattaatatttattttaaaatgagtcgagtgaataactcattcgatttatttgcagaggacaagcgattgtttatttatatttcaatcttttcttttttagctaaatgtaatctaattaaaagctaatatatttgatttaatgtgattgttgtgtttcttcctctcctgtggcataatcgcgcgtatacatcgaaggagcgtatgaaaaaaatatgagaataaaatcactggaaacatacaattctcacagcaagttgagaataaatagaattgaattcgactcgttgactttaatggttggcgcatccggtgtaggtaaaacccagatacttcgatcaattaataaaataaagtctattgcgaacggcgattcagttagtggttttgaatggattgttgaattcaatgctgaaggaaacgactattattggtcaggtgaatttgaagcattaactgattatgatgaatttacttatggcatgtttaattttgatgatgatgataaaattgaaccaaagattcgagccgaagaagtaaaaattaacggggtggttgtagtatctagaaatggcgatgatatagtttataaagacagtaaaacagttaagctagcttcaacagttagtatagttcatcaccttcgcgaagaagatgatatttcagccatacataattctttttctcgagttgttgaagtagatgcagatgaattgcaacgtgtcttccctagaaaaaataaagacatgtctgagagtgaagatttgacgattactgaaatcagggagaagtcgttttcattaagcgcgaaactttatttgtgtcaggaaaagcaacctgaatactttcaacaaataaaaaattcatttgttgagatttttccatatattgaagatgttaaagttgttaaggttgacaccagcagttttccgttctttgtgcactcagtctatgctctcaaagtaaaagagcgtggtattgaagaatggatttctcataactcaatgtccactggtatgcttaaaacattagttcaattagcttatctgcatttaagccctactggaaccgtattcttaattgacgagtttgagaatggttttggtgttaattgtattaatgatattactgatgttttaattcatcatggtaatgatgtgcaatttattctgactagccatcacccttatataatcaacaacatccctttgggtaattggaagatcgtatcaagaaaagctggtgtagtggataactactcggcggatcattttaatttacaagaatctaatcacgaagcattcactaagttaattaatttaagtgtttattttgatggtgctgatagatgaatttatatattttagccgaaggcaaacaaactgaaagacgtctatatccagcatggatggacgtcttgtctccgtctgtaactaaggtggattatttgtcggccattgataataataactattattttatcagtggtgagggttaccctcggatgctagatgtgaccttggttaatgctctaaaggatcttactgaaaataaaaagataaccgatttttgggttgcattagattctgaaggcgaagatgttgagtctagagtgaagttggtgatggaaaaaatagctacttctggcatggatatctctcattgtaacgttcatgttattgtgcaaaacccttgcatagaaacttggggcttaggtaataaagttataatttcacccaataaactcaatccaacattcttgggcttccttaatcattatgatgttcaatcgaatgatcctgaggaaatgcagaaaccatctttctatgaagggtctattgcgaagtaccatgagagctatctaaaaagtatgttggcgttaaggaatgccacatatactaagaaaaaccctgctgcactaatggaaccctcgtatcttcaacagcttatcaacagagcttatgaagatgaggggcatatacagagctttaggctttttcatacgttagctacgcagctcgaagcccgggcacaagccatgaatgctgtaggtgcgtgaaaatttatgtattcggtttatcagcatatttgtgaatgatgaattgcatttagttgcatcattttgcattagttgcttaatgccaccctaatgggtctcatagcagatggcatatgactttattgctaaggggcaattgcattaaaaccgacccatcaagcgggcaggcgtggcggggaaagcattgcgcgccagcggtggtgcgtatattaaaaaatactgtctgagtgcgtcatgatgggcttaacgagatcgtttctggttcgtgggtggttctgtgcgaacgtggggctatggcttgtctgtggagcgatgcgagagggtgagatcagtagcacaattctacggttgcgcttccgttaatatcctcatcggcatgtcatgttccccaccaacagctggaggctttaatggataactatcacattacaaaagatggcgataagtggaagtttcaaaaggaaggaaacgagcggcctagcaagacggcatctactaaggctgaaatcatgcaggaaatgcaggattacatgtctgataagactggctcagtgaaaattcatacagaagacgggaaaattcaagaggagcggacttatcctcgcaaggccgatcctaaaaaaactaaaggctaattatattgaagccgccatcatggcggcttgagaaaaattattccgggttgtctagagtgtactctttgaacctgatgacctccatgccgagccactcgtttacctccctgaacctgtcctgcaggggcgacagctcgttacgaacgaatacctttgccaccttctcaacgtcgccggttgagccgatattctcgggcttgccgcccatgagctggaacggtacgcggtgcgcgtccatcaggtcggcggcactggccttcttgatgttgaaaaaatcatcctttgtggcgacctcgctcagtggaacgattttgatgccgtccggttttccgccgggggcgtagaaaaacaggttcttaaagttgccgagccccttcgagttgcgcatcgcctcgcgcagcgattcaacgtcggtcgcgctctgcgccgggtcggttacgtacatgatgtaccccgcatgcgcaccgttctggtaatacttgcggcggaacagcgttgcggcttcattcagccaggcggaattaagcgcgctgagatattccggcagaccgtaaatttcctgattaatgtcaggctccagcagatgaaacacagtatcaggcgcgaactcatgcggcagcgtgaagttttccacaaaccagaaaatcgaatcatcgaccccacgtcgggtgtacttggccggtgaggccagtagcttgattagctggccggtgacgctgtggcgcttctcaagaaaggcgttgccaaagaccagatagtcgagcgcaaagcggctgaaatcctgacgggataataacgggtgcggaatgtaggtgctcgcgagcacgttgcgcttaacgtaaatcggtgagctgtgatgcacggcagagcgcaggcttttcgccaggccggaaaaactgaccggcggctcgtaccatttgccgttactgatgcactcgacataatccagaatatcgcgtttatcgagcaccggcacaggctcaccgaaggtgaatgcctccattttttgcggggcgctggcggtcagttgctgtggtgcgcgggctttctgtgcggcggctttgcgggatttttgcttacccatcagttgaactccagaatagatttaggctgcatgccgctaccggcggaaagcggttcgtttaacagggcgtgcatggtcgcccatgcgatatcggcgtgactggcttcctcggtgcggctggcctcataagtggcgctgcgcccactgctggtcatggttttgcgaatcgacatgaaagactgtgttacgtcggtagccccggcgtcgtactccagacagccacggcgaatagtgtcttttgccttgagcaccatcgcggttttcatctcaggcgtgtaacggatgcctcgtgccgccgggtagaatgagcgcaccaactggaacacgccgaggccgaggccggtcgcgtcaatgccgatgtattcgacgttatatttttctgtcagcttgcggatcccttctgcctgagcggcaaaatccatgcccttccactggtggcgctccagcatgcggaacttgccacccgagaccaccggcggcgcgagcacgacgcatccggcgctgtcgccggtgtgcgacgggtcgtagccaatccagaccgggcgcatgccaaacggatggtcggcgaagggggcaaaatcatcccattgctccatcacatcaaccatgcagcgctgcagctcctcgaacgggaataccgacgctttatcgtcgacaaactcgcacataaacaggttcttaaagtcctcatcactgttttcgcgtttgagctggtcgaggtcaaacagggtgcagccaccggcaagcgcatcctcaatggtgacaatctgccgccactggccatcgtcgcagagctggccaccggcgagcgcactgtggctgatgtcgatttcgatgcggtcggcgatacggctgcgccccttattgaacaactcgccagaccagaaggggtaagcaccgtgcgccagtgtggagggtgttgaaaagtaggttgagcgcaggtgcttctgcgaggccatgcccgacgcgactttgcgcagcttctgaaaattcgggatccagaatatttcatcgacatacaggtcgccgttatggctctgcgcggtgttcgaattggtaccgagaaaaatcagctttgcgccgttattgccgatgacaatcgggtctccggaaaggtcgacgtcaaccagtcgcgcaaactgaatgatgtattcccggaacacgtaagcctgcgttttactggccgacagaaagatttggttatggccggtcttgagcgcgcgcagcaacgcctcgcgggagaaatagaacgtcgcgccaatctggcgagatttgagaatgtcgcgaatacggtgctccagccccgcgcggtaccactgcaactggtattcgaaagactggtcgaagaataattcttccagtctctcgatagcctcgtcactgaaaaaattctttttcggttttttgcgctcacccttgttgcggttggcgacgttggggtttaggtcggcctcgttgccggtctggctgtagcgattaacgcgcgccagtcgttcaatctggcgaccgagcaggtcaatctctttgaagtcgccgcctgacttttgcggcttggcgatgagctgaatcaggcgtgcctcaaggctgctttcgacgcgggaaatcggtgcaatgccgtcccagccgtcgcgctgcttccagctctgcacggtcgggcgcttgacctgcagcatttcggcaatctgtggtacggaaaaaccctgccagtaaagcagtgatgcctgccgtcgcgggtcatgcaacaaggttgtatcggtggaaatggtcattgatgcctcgccgttgtggattcagggcaaggctacttaatggtcgtcagtgattcgctaaggtgctgttgtgcaggcggttatccagtcgccattggtggtctggtgtggtctgagtctggaaactggcggtgaccagtaaccacaacctcaggattcctgacaatggcaaaaaaagtctcaaatttctttcgcatcggcgtcgagggtgatacctgcgacgggcgcattatcagcgccagtgatattcaggaaatggccgaaacctacgacccgcgtgtctatggttgccgtatcaacctcgaacatcttcgcggcatcctgcctgatggcttattcaagcgttatggcgatgtgaccgaactgaaagccgagaagattgacgacgattctgcgcttaacggcaaatgggcgttattcgccaaaatcaccccgaccgatgacctgattgcgatgaataaagccgcgcagaaggtctacacctctatggaaattcagccgaattttgccaataccggcaaatgctacctcgtcggccttgcggttaccgatgacccggcgagcctcggcactgaatacctcgaattctgccgtaacgcgaagcacaacccgctgcagcgcttcaaggccaatcctgaaaacgtcttttccgctgccacgctggccgaactggaatttgaagccgttcccgacacggtgttcaacagcttggccgataaggtgaaagccattttcagccgtaagcaggtcagcgacgatgcacgcctgaatgatgtgcatgaagcggtgaccaccgtcagtgagcatgtgcagacaaacctcaccaaacaggatgagcgcctttccgctatggaaaccgcgtttgccaccttcaggcaggaactgaccggcaagattgaagaaaccagccaggcattttcaaccctgaaaaccacccttgataaaaccgaaagtttcagccagccgcgacgcacgaaagccagcggcggtggtggcgacgagctgctgaccgactgctgataaaacgcagaccaaaaccgggcggtaaccccgcccgatgctgtgactaaccgattaattcaaacaggaaatactatgcgtcaggaaacccgttttaagttcaatgcttatctgacccagctcgccaaactgaacggcatcagcgttgatgacgtcagcaaaaaattcaccgtcgagccgtctgtcacgcaaacgctgatgaacaccgtgcaggcgtcgtccgcatttctgcagatgattaacatttttccggttgatgagctgaagggtgaaaaaatcggtgtgggtgtagatggcactattgccagcacgaccgacacctcaggcgacgatgagcgtgaaactgctgactttgtcgcgcttgagtccaatttgtacgagtgcaatcaggtcaactttgacttccacctgcgctacaaaacgctcgacttgtgggcgcgttttcaggactttcagcgccgcatccgtgacgcgattatccagcgtcaggcgcttgatttcatcatggccggttttaacggtactcatcgagcgccgacctcgaatcggaaaactaacccattgctgcaggatgtagcggtcggctggctgcagaagtaccgtaacgaagccccggcgcgtgtgatgagtaaaatcaccgacgctgacggcaaggtcgtttccgatgtgattcgcgtcggtaaaaacggcgattatgagaacctcgacgcgctggtaatggatgcgacaggcaccctgattgatgaggtttatcaggactcaactaaactggttgccatcgttggccgtaagctgctggccgataaatattttccgctggttaacaagcaacaggaaaacagcgagtcgctcgcggcggataccatcatcagccagaaacgcatcggcaacctgcctgccgtgcgtgtgccgtacttcccggcgaatgcggttcttgtgaccacgctggaaaatctctcaatctatttcatggatgagagccatcgccgttcaatcatcgaaaaccctaaacgcgatcgcgtggaaaattacgagtcgatgaacatcgactatgtgatcgaagcgtatgccgccgggtgtctgctggaaaacatcaccctgggcgatttcactgcgccggaagctgaggcgcaagccgccgaagcaccggaaggcggagagtaagcccatgacgagccccgcacagcgtcacatgatgcgggtctcggcctctcaagccgcgcagcgggaacaagccccgctgcgccacgcatccgcctacgagcagatgctggtaaagctggccgaagaccgccgcatgttaaaaaacatccgttcaaacgagcgcaaagccgagaaaaagcgcgagctgctgccgttctatgcgccgtgggtcgccggtgtgctggctgatggccgtggtgcgcaggatgacattgtcatgaccgtcatgctgtggcgtctcgatgccggtgacattgctggcgcgctggaaatcgccccctacgcgctgaaatacggcctcacctctgaccatcgccgcaccacgccttacatgctggttgaggaggtggcacttgccgcgcagcgcctgcgcgataccggtgagcctgtcgacctcgcattactgctgaccaccctcagcctgactgacggtgctgacgttcccgatatggtgcgcgcccgtctgcacaaggtgaccggcctgacccttcgtgatgcaggtcagaacgccgacgcgctggcgcagtttcagcgcgcgatgcagctcgaccgtaacgccggtgtgcgcaaagaaattgagcggctggaacgggcattaaagccgaaagcggaagcgctaccccgtaaaacgactaaaccgcgcacgcgcaaaactgccaccaaaccggcagcgaagcgcggacgcccaccaaaggcggtaaaaaccgccggttaactgaacgctccccgagccgggcggcacgccggtcaaagcgggtattaaccctgacggcgaccggcgtccaccgcccaacctaatgaggttgtcatgacgacagtaatactgaatcagcccgacgaaccgcagggcgtaccgggcgtggtgattcccgcaccggagacgggcgacgcagtgattaaaaacacgttcttttttcctgatgtggatccgaagcgcgtgcgtgagctgatgcgccttgagcagacggtttccgatgcgcgtctgcgtaacgccatcaagatcggcatggcggaaaccaatgcggagctttacgactaccggctgcaccagattgccgcaggctttaaagaactggccgacgtgcctggcgccgaggaaatcgacggcgagaatgtgcgaattttccactacctgagcgccgtgacggcgatggcgaccgccacgctgtatgagcgttatcgcggggttgaggccaccggcaagggcgataaaaaagccgacagcgtcgaaaccaccattgatgacctgtggcgggatatgcgctggtcggtcgcacgcctgcaggataagccgcgctgcatcgtgggtcagctctgatgaaagtctatgcgatgcagggcgacaccctcgacgcactttgcgcccgctattacgggcgcactgagggagtggtcgagaaggtgctgcaggctaatcccggcctgtctgagctgggcgtcattctgccgcatggcacggcgattgacctacccgacgttgaaacatcacccacggcggagaccctgaacctatgggactgagtatggaaaaaatcaccacgtttatcgcctactggctggccgtgggggtggcgtatttcggggcaatgtcgcccgaaaagctggcgctgtatgtgggtagtctgtgcgccatttttacggcggcggtgaatttctggtaccggcgcaaaacctttcgctatctgaccgaaatgggaatcgacaaaggggtgacccgtgagctcaatcgttaaacgttgcagtgtggccgcagtgctggcgctggcggcactgatgcctgattttcgtctgctgaatacctcgcctgatggtctggcactgattgccgacctcgaagggtgtcgcctgacaccttaccagtgcagcgcgggcgtgtggacatcaggcatcggccacactgccggggtggtaccgaaacgcgatatcaccgagcgcgaagcggcggcaaatctggtcgccgatgtactgaacaccgagcgccgtctcgcggtctgcgtgccggtcaccatgccgaaacaggtttacgacgcgctggtcagtttctcttttaacgtcggcacaggcgcggcctgtcgctcgacgctggtctcttacatcaagcgtcatcagtggtggcaggcatgcgaccagcttacccgctgggtgtacgtcaacgggcagcgtaataccggcctcgaaaatcgccgtcagcgtgagcgcgcttactgtctgccgggggtgaaatgaaagttgtagtcatgctgctggtactggccgtactcggcctgctgtggttgcgtcatgagaacggcaatttatcccgctcctttgagacggcaaaccgggtcgcgagcgcacaaaagacgacgattggcatgctgaaaaatcagctcaatgtcgcgggtacgctcgcccgacgtaatgaatccgcgcaggtggcactgcgtgaacagctcgcaaaggcaagcgcagaggccagccgccgtgagcagacgataacgaggttactcaatgaaaatgaagcctttcgccgctggtataacgctcctttgcctgatgttgtgcgtcgggtgcacttccgccccgcctgcgccagcgccggtgattgtggtcagtggatgcccgagggtgagcctttgcccgatgccggaaagtgatccgaaaactaatggtgacctgagcgcggatatccgccgccttgagggcgcgctgaccgcctgcgcgctgcaggtcaaaaccgtcaaacactgtcaggatgaactcgatgcagaagcacaaaagcctgcgcacagcactgattaacgccgtgccgcagctccgaaataaccccgagatgctgcgcctttttgctgacaacgggcataccgattcccgactggcgaactcgctgtcgtttgaaaaggtgtacgtgcttaacgtggtggttactgacttcaccggcgatcttgatttgatattcgtgccggtgcaggcatggctgcgcgaacatcagccggacattatgaccaccgacgacggtcgggaaaaaggattcacctggatgattgatgtcaataacgacgattcactcgatatcagtatcagcctgaggctcaccgagcgcacgctcgtcaaagaggtcgatggcgcgctgcatgtcagctatgccccggagccgccactgcctgagccggtgacgcgcccggtggagttgtacgttaatggcgaactggtgagtaagtgggatgagtgacttaaccgtcctgcaggaacgccttgcaggtctgattgccagtttgtcaccggcggcgcggcgacaaatggcggctgagattgcgaaaaagctgcgcgccagccaacaacagcgcattaagcgtcaacaggtacccgacggcaccccgtatgccgcgagaaagcgccagccggtgcggagtaaaaaaggccggattaagcgcgaaatgttcgcgaaactgcgcaccagtcgctttatgaaagccaaaggcagcgacaatgcggcggtggttgagtttaccggcaaggtgcagcgcatggcgcgggtacatcagtacggcctcaaagaccggccaaaccgcaacagccgggatgtgcagtacgaggaacgcccgttgctcggttttacacaagaggataatatattaattcaggacgcaatgatttccattttaggaaaagggtaatatctatgaatcagcctaatactttatataaatatgtaaggccggggtctttaaagttaattctagaaaatcaatcgttgagatttccaacccctaaggaatttaacgatccctttgattgtaatttccctagttacttgggttcgattaatatggaaaaaatatttattaagagctttcctagaagtatgggggaggacaagaaaaaactactagcacatattaaaagagaaaatgtattttcaggctttcacgaaatgatactttctaatattgaggatgttcgcaaaagttgggatgaatacatagaaaactacagagtattatgcttagctaaagaaaaagataacattctgatgtggtcgcattatgcggtcaaccactctggaacagttgtcggctttgatacctcggccgaaaaattcacatcggaagctcgtccggtgagctacccaaataaaaacaatactctagatgaacagatgaaagttcaccttgctgaagtgtttaaatacataatcaatcataaagatggaattgatgccgcctttagtgaaggtaatgcattcttaaatcatccgaataagtcactcctccttgcaaaatatgtcataaacaagttaagcccatttttctatgttaaaaaaacaatatgggaatatgaaaatgagtttagattcattaggcaaaaaaggaatcctgactcggaatggttgaaatttgacatctcctcagtaagtgatgtgacttttggcattaaaacctctgcatctgagaaggaacaagtcatagcattactcaaagaatataaagccacgccctcagtttatcaagctgtcaaaaaaaatgcagaaatggtgtttgcaccgatgaggttgtagttacataaacagcattttcataattaacacccgtgttgtgtgatagtcgatactattctgactctttgccgtttatggatatgagcggcattcttcacacactatgaatactttaaataatatccaagatctcgcgcgtgcgattcgcaacctcatccgttcaggtgtggtgactgaggtcgataccgtgcaggggctgtgccgcgtacaaagcggcgggatccaaacgacctggctgaactggctgaccacccgcgccggtcgttcgcgcacatggtgggctccctcggtcggtgagcaggtgctgctgctggctatcggtggcgagcttgataccgctttcgtgctgccgggtattttctcggacgataaccccgccccgtctgcctcggcggatgcgtggcatgtggttttccctgatggcgcggtcattgagtatgagcccagggatggcgcgctgacggtaagcggcattaaaaccgccgatgtgaccgcatcggaatccatcaccgcaaccgtgccgctgatactggtgaaagcctcgaccagtatcaccctcgacgcgccggaagtgatttgcaccaacaagctgacgacggcgacgcttgaggtgcagaagggcgggaccatgcgcggcaacattgaacataccggcgggaaactcacctctaacggcgtgcaggttgatgaccatgaccacggtaatgtccagagcggcgggaactggactaaggggatccaatgacggcacgttatcagggcatgaaccgaaataccggcatcggcatcagcgacactgagcacatcagccagagcatgcgcgacatactgctgacgccggtcggctcgcgggtgatgcggcgtgaatatggctcgctcctgtctgcgctgattgatatgccgcaaaaccctgcgctcaggctgcaaatcatggtggcgtgctattccgcgatccagaagtgggagccacgcatcagacttacatccatcagctttgagaccggcggcgctggcgagatgtatgtcgatattaccgggatgcgtaccgataccggtgcgtcagtttcaaccaccgtttcactgagttaaatcactatggcaactgttgacctgagtcagttacctgttcccgatgtggtagaggaactggattatgaaaccatccttgcggaacgtatcacgacgctgatttcgctttatccggaagaccagcaggaagccatcgcccgaacactgacccttgagtcagagccgattgttaagctgttgcaggagaacgcctaccgggaggttatctggcggcaacgggtgaacgaagcggcgaaggctgtgacgctcgcctattccaccggcaccgaccttgacgtcgtggccggaaacaacaataccgaacgcctgaccatcaccccggcggatgactccaccatcccgccgacacctgccgtcatggaatcagataccgacctgcgtctgcgcgcgcaacaggcgtttgaggggctgagcgtggcgggtccggtcggggcatatgaatatcacgggcgcagcgctgacgggcgtgtcgctgacgtctcggtcacaagcccgtcgccagcctgcgtgacgattaccgtgttatcccgcgagggcgacggcaccgccagcgaagagttactgacaatagttgataaggcgctgaatgccgaagatgttcgcccggtagctgaccgcgtgaccgtccagtcagcggagattgtgccctaccagattgatgcgacgctctacgtttacccaggccccgaatctgaacccatcagacaggcatccgagcagaaactgcagagttatatcagcgcgcagcaccgcctcgggcgtgatatccgcctgtcagctatttacgcagcgctgcatgttgaaggtgtgcaacgggtcgaactggcatcaccgcaggccgacatcgtgctgagtaaatcgcaggcgtcaaactgcaccgagtaccagattgctatcgggggatcggatgagtgaccggctgttacccgcaggctcatcaccccttgaggttgccgctgccgccgcgctcgcagagattaagcgtgtgccggtaccgcttcgcaccctgtggaactggcgcacctgcccggtaaacctgctgccgtatctggcgtgggcgctgtcggtcgacaggtgggatgaaaagtggccggaagcgacaaagcgcagcgtctgtgcgtcctcgttttatgtccatcagcacaaaggaaccatcagtgcactgcgtcgggtggttgagccgctcggctttctgattgaggtgcgcgagtggtggcagctcaacgaggcgccaggcacattccgtcttgttgtcggcgtgctcgacagcggcatcactgacgaaatgtatcaggagcttgagcgcctgattgatgacgcgaaaccggcaagtcgccatctgaccgggctggctatcagcctgagctcgaccggcgagctgtatgtcggcgcgggatgctacgacggcgacgcgctgaccgtttacccctacacccccgaggaaattgtcgtcggtggtgaatattacccggcctcggccattcatttgattgataacctgagagtgaacgcatgaccgcaaaatattttgccattctgaccaatcagggcgcggcgcggctggcgaacgcggcggcactcggtactaagctcaacctgacgcagatggccgtcggtgatgcgaatggtacgctgccgacccctgacccggcgcagacgaagctcattaaccagaggcgcatcaggccgctgaacctgctgaccgttgacccggacaataacagccagattatcgcggaacagattattccggagaatgagggcggtttctggatccgcgagattggcctttacgatgatgaggggattctgattgccgtggcaaactgcccggaaacctataagccgcagctccaggagggaagcggccgcacgcagaccattcgcatgattttgattgtgtcgggcacgtcggccattactttaaaaatcgacccgtcggtcgtgctggcgacgcgaaaatatgttgacgataaagctattgaggtttcgagttacgccaacgaaatcatgcgactgcataagcaggacagcaatcctcattcacagtatgcaccgattcaaagcccggaatttacgggtaaacctacagccccgacaccggcaaaaaattcgaatgacaggcaactggcaacaactcaatttgtcagcaccgccatcagtgaactggtaagcaacgcaccggcggcacttgatacgctcgcaaagctcgcggctgcgattggcaatgatgcgaatttttcgaactcactgtcggaaatcatcaagaacaaacagaattacgataagacattaagtgatttagccgggaaaacacctgctcaaattctgttatatcttggcctgccttcgcttattaccggtaatgtcaccgagtcgctgaatacgctggaaaaagtggcaaatgccattgataacgatgctaattttgcaaattcaataaaaaccatactcgggaataaacaaaataaggacgataccttaacaaatctgtccggaaaaacggcggcgcaggttgccgtatatataggcgcgcttcgccagtcacaaaatctggctgatctgcctaaccctgaaaccgccaggacaaatcttgaggtgcctcgcggtgtggatgctcagatgccctttgcctggtgtaagttcaacggcgcatcagggctgatttatcgtgcgcataatatttcaagcgtccggaaagacgctaccggacgctttgctttcaatttcacgcgcgcatccgtgacatcagattatgcggttattggtagcgccgtactgcccggcgcaccggttgaccagattgtccgtgtatttggtgcaacagacaggctgacaacagggtttaacgttgtcgcgatggataacaataccgacacgtatgctgatgcagtaatcgacgtgtgtgttttagggggctgatgatgcaggcaattattttcgaaaatcagggggctgccggggtgctttttccggcggcgtgcggattgtccgtccttgatattggtcgtaaggatgtgcctcagggggtcagcttctggattgtcaacgctgaggatttaccgggtgccgcgcttgaggcgtgggagctcaacatcaaaaaaatgggtgcaccggccggaacaggcgggacatatattgccgcagaaggagaaattgatgataacggtaaataaaaccagcctggctgcaattgatgctgaaaaaatccgggcgcgtcgtgatgcgctgctccgcgaaagtgactggtcgatgatgccggatgcgccaacggataaaaaagcatgggctgcttaccggcaggcattgcgcgacataccactacaagaaaaatacccgtcagtggtggcatggccggaactgcccggcgaagaataatcaggctatacaggcgggctgatgcccgtcttttttgatttgtttatgtgccattcgctatccatcgccgacaaatagcccctcaccagaccagccaggacaataacactcgcccactaaccacggagttaaccggatgagtgattttcaccacggcgtacaggtgcttgagattaacgacggcacccgcgtcatttccactgttgcgaccgcagtcgtcggcatggtctgtacggccagcgatgcggatgcagcaacattccccctcaatgagccggtgctgattgccaatgtgcagagcgccattgcgaaagccggtaaaaaaggcacgctggccgcatccctccaggccatcgccgaccagtcaaaacctgtcaccgttgtcgtgcgcgttgccgaaggtaccggagaagatgcggaagcgcagacaatttccaacatcatcggcggcacggatgagaacggtaaatataccggtatcaaggcgctgttgactgccgaagcggtcaccggcgttaagccgcgcattctcggcgtgccgggtctcgatacgcaggacgtcgcgaccgcacttgcatcggtctgtatcagcctgcgagcctttggctacgtcagcgcatggggctgcaagaccatttctgacgccatcaaataccgcgacaatttcagccagcgcgagctgatggttatctggcctgacttcctttcgtgggacaccaccgcgaacgccaccgcaacggcctacgccactgcgcgcgcactcggtctgcgtgcttacatcgaccagactgtcggctggcataaaaccctgtcgaacgtcggcgtgcagggtgtcaccggtatcagtgcctcagtgttctgggatttgcaggcatccggcaccgatgctgacctgctcaacgaggccggggtgacgacgctggtgcgtaaggatggtttccgcttctggggtaaccgcacctgttctgatgatccgcttttcctgtttgaaaactacacccgcaccgcgcaggtactggccgacgcaatggctgaggcgcacatgtgggcggtcgataagcccatcaccgcatcgctcatccgcgacattgtcgacggcattaacgccaaattccgcgagctgaaatcaaatggctacatcgtggacggtgaatgctggtttgacgaggaatcaaacgacaaggacaccctcaaggccgggaaactgtatatcgactacgactatacgccggtgccaccactggaaagcctgaccctgcgccagcgcatcaccgataaatatctggtgaatctggccgaatcggtcaacagctaaggagcctgaaacaacatggcactaccccgcaaactcaaatatctgaacatgttcaatgacggcctgagctacatgggtgttgttgaatccgtgacgctgccaaaactgacccgcaagctcgaaaactatcgcggcggtggcatgaatggcgcggccgcgattgacctcggcctcgacgacgatgcgttaaccgtcgaatggtctgttggcggtctgcctgatgtggcgctgtgggcgcagtatgccgcgccgggtgctgatgccgtgccgctgcgtttttctggctcttaccagcgcgacgacaccggcgaaatcgtggcggtcgaggtggtcatgcgtggccgtcataaggaaatcgatggcggagagaataagcagggtgaaaacacctcgaccaaactgtcgaccgtgtgcacctactaccgcctcacgattgatggcagcgacatcatcgaaatcgacaccgtcaacatggttgagaaggtgaacggcgtcgaccgcctggagcagcaccgccgcgcaatcgggctgtaattccctgaccggtcagcactgctggccggttattaatcccattcagagcagagaaaaacatcatggcaaaagcaccacgtaaaaccgctgaatttgttgatacgactggcaatgaagttgttaccgaaaaccagaacgtcgtgaccctcgacaagccgatccagcgtgccggtcagacgattgataaagtcaccctgattgagccgaacgccggtaccctgcgcggcgtcagtctggcggctgtggcgcagtccgaagtcgacgcgctgattaaagtgctgccccgcatgacctatcccgcgctcaccacgcaggagctgaccgcgatgaacctgcccgatatgctgtcgctggccgctaaggtgattggttttttgtcaccggcttcggtggaatagattttccgcccaacctgtcgaccgatgacctgatggcggatattgcagtgatattccactggccgccatcagagctatattccctgagcctgaccgagctcatcacatggcgcgaaaaggcgctgcagcgtagcggaaaccacaatgagtaataacctgaggcttgaggtattgctgaaagcggtcgaccaggcgacacgaccgcttaaatccatccagaccgcgagtaaaaccctgtcgggcgatattcgaaacacacaaaaagggctgcgtgacctgaacggccaggcgtcgaaaatcgacggctttcgtaaggcaagtgcgcaactggccgtaaccggtcaggcgcttgataaagctaaacgcgaggccggtgagctggccgtgcagcttaaaaacaccaccagtccgacccgcgcgcaggcgcaggcactcgacgcggcaaagcgtgccgcctctgagctgcagacgaaatacaacagcctgagaacgtcggtacagcgtcagcgctcggagctgatgcaggccggtattaatacccgcaccctgtctgccgatgagcgtcggctcaaaacctccatcagcgaaacgacagcgcagcttaaccgccagcgtgaagcactggcgcgcgtcagtgcgcagcaagctaagttaggccgggtgaaagagcgatataaatcaggcaaggagcttgccggtaacatggccgctgcaggtgctgccggggtcggtatcgcgacagcgggaacgatggcgggtgtgaagttacttacgccgggttatgactttgcgcagaaaaattccgagctgcaggccgtgctcggggtcgataagcaatcaccagaaatgcaggcgctacgcaaacaggcgcgccagctcggcgacaatactgccgcgtctgctgatgacgcagcgagcgcgcaaatcatcattgcgaaaagcggcggtgacgctgctgccattcaggcagcgacgccggtcacgctgaatatggcgctgtcaaaccggcgcacgatggaggaaaacgctgcgctgctgaccgggatgaaatcagcatttcagctttcaaacgacaatattgcgcacattggcgacgttctctcgatgaccatgaacaaaaccgccgcagattttgacggcctgagcgacgcgctgacctatgccgcgccggtagcaaaaaatgccggggtgagcatcgagcaaaccgccgcaatggtcggtgcgctgcacgacgccaaaatcaccggttcaatggcgggcacgggtagccgcgccattctcagccgcctgcaggctcccaccggacaagcgtttgaggccatcaaggagctcggcgtcaaaacgtccgacagcaaggggaacacgcgcccgatattctccatcctgaaagaaatgcagcgcagctttgagaaaaacaacctcgggacaagccagcgcggcgagtatatgaaaaccattttcggcgaggaggccagctcggcggcggcggtactgatggaagcagcctcaagcggcaaacttgaccggctcaccgcagcgtttaaagcctcggacggtaaaaccgaggaactggttaaggttatgcaggataacctcggcggcgactttaaagagttccagtctgcttatgaggcagtcggtaccgacctttttgaccagcaagaagggtcactgcgtaagctcactcaaaccgccacacaatacgttttaaagctcgacggctggatccagaaaaataaggggctcgcgacaactatcggcatcattgccggtggtgcactggctctgattggcatcatcggcggcattggcctcgttgcctggcctgttgtcatgggaatcaacgccattatcgccgccgctggcgtgatgggtacggtctttactgtcgccgggagtgccattgtgaccgcactcggcgcgattacctggccgattgtggccgtcggggcggcgattgtggccggggcactactcattcgcaaatattgggagcccatcagcgcatttttctcaggggtgattgagggcatcatgagtgcctttgcaccggtcgggcaaatgttcgctccactgacaccaatctttgacgggctcggtgagaagctgcgcggtgtctggcagtggtttaaggacctgattgcaccggtcaaggccacgcaggagacgctcgatagctgtaaaaatgtcggcgtcatttttggtcaggcactggactcagcgttgatggcaccgcttaacgtctttaacaagctgcgaagcggtgtcgactggcttctcgaaaagctcggcatcatcaacaaagagtcggacaatctcgaccagaccgccgcaaaaaccaacgccgccacgcagggtaattcctacatcccggcaaccagcacatatggcggctatcaggcttaccagccagttaccgcaccggcggggcgctcttacatcgaccagagcaaaagcgaatacaacatcactctgccgggtggcgttgcaccggggcatcagcttgaccgacagctacgtgacacgcttgaacagattgagcgtgataaacgtgcgcgccagcgtgccagtatgagtcacgactactgagagggatttaaacgatgatgcttgctcttggaatgtttgtgtttgagcgccgcaccctgccttatcagtcgatgcagcgctcaaaagattatcgctgggcgtctaatgaccgggtcggcaagccgcctgcatatcagtatctcggcgaaggggaaacttcactccagcttgccggtacgctttaccctgccattactggcggccgcatttccctgcaggccgttgagctgatggccgacgagggcagagcgtggcctctcattgagggaaccggcacaatcctcggaatgtttatcgtcgacaaggtatcgaccacgcacactgagtttttcagtgatggcgcggccaggaagattgattttacgctttcgctaaaacgggttgatgagtcactgacagcgatgtttggcgatctgaataaacaggccggggagcttctcggctctgtcggtaatctgaccgataaaatgcagggtatgctcggagggctgacactatgataacgggcatgaccatcgacgccggtgccagccttgcgccggcctttatgctgacaatgaacagtaaggacataaccagcaattttagtgaccggctgatttctctcaccatgaccgacaaccggggctttgaagctgaccagctcgacattgagctcgacgacaccgacggaaaagtcgagctgcccctgcgcggggcggtgctgacgctgtggcttggctggcagggctcggcgcttctgaataagggcgatttcacggtcgatgagattgaacaccggggcgcgcccgacaccctgaccattcgcgcacgtagcgcagactttcgcggaacgctcaattcacggcgtgaagaatcatggcacgataccaccctcggcgagctggtcagcaccatcgcaaagcgcaataaactgacggccagcgtagcggattcactgaaaaaaataccggtaccgcatatcgaccagtcgcaggagtccgacgccgtatttctgacccggctggctgaccgcaatggggcgacggtgtcagtgaaagcggggaagttgctgtttctgaaagccggtagtgcgatgacggccagcggcaaacccatcccacaaatgacgcttactcgcagcgatggcgaccgtcatcagtttgctattgccgaccgtggagcttataccggcgtaaccgcaaaatggttgcataccaaagaccctaagccgcaaaaacaaaaagtggcgctgaaacgtaagccaaaagaaaaacacctgcgcgcactggagcatccaaaagcaaagctggtcagcaaaaagccaaaggccaaaaaagagccggaagcgcgcgagggtgagtacatggccggtgaggccgataacgtgctggcgctgacgacggtctacgcttccaaggcgcaggcgatgcgagccgctcaggctaagtgggataagctgcagcgaggcgttgcagagttttcaattacgctcgcgcttggcagggctgatttattccctgagacaccggtgcgcgtatcgggctttaagcgcgtcatagacgagcaatcttggttaatcagtaaagtgacccataatctgagtaatagcggcttcacgacgggcttagagcttgaggttaaactctctgatgtggagtacagcgcggaatcggataacgaataaaattaattcacaaaaagtgaatcgatggttatcattgcttcacgaattgagaataagaggtggattatgtttcattgtccgaagtgccatcatgccgcacatgcgcgaacaagccgctatctaaccgaaaacacgaaagagcgctaccaccagtgccagaacatcaactgtagttgcacatttatgacaatggaaacgatagagcgctttattgttactccgggagccattgacccggcaccgccgcacccgactgtcggtggtcaacgaccattatggctctgataaatttccgctaaatgcccgccgcgtgcgggtttttttatgccctcagcaaagtggcggtaaaaaatccaccgccattctatcgccactcgaaaacgaggaaacaaaaaggccactcgcgaaagtggcctaaatatatgtatttacttataaaatctggtggcccctgctggacttgaaccagcgaccaagcgattatgagtcgcctgctctaaccactgagctaaggggccgtggcgggggattataatgtaacttcccgcttcaatccagccataagcgtgtgcctgccgtttttataaacaacctataatcaatcctttatactttatggatgatcccataactggagctttagatgatcaacgatattctcgcgcctggcctgcgggtggtgttctgcggcattaaccctggtaaatcgtcggcgcatacgggctttcattttgcgcatccgggcaaccgcttctggaaggtgatccatcaggcgggctttaccgacgagctgctgaagccggagaaggagatgcggctgctggatacccgctgcggcatcaccatgctggtggagcggcctacggtgcaggccagcgaagtagacctgcatgagttgcgtaccggcggccgtgagctgatcaagaagatagaagactatcagcctcatgcgctggcggtgctgggcaaaaaagcctatgagcaggcgttcagccagcgcggtgtgaactggggtaagcagaagatcactattggcgcgaccgaggtatgggtgttgccgaatccaagcggcctcaaccgggcgacgctggataagctggtggaagcgtaccgggaattagatgaagcgctgatcgtgcgcggtttatagcgcccataaaaaaccctccggagagggcttttcacaaacggcttgcgggcgattaatcgtccaggaagctgcgcagcacttcagaacggctcggatggcgcagtttacgcagcgccttcgcttcgatctgacggatacgctcacgggtaacgtcgaactgtttacccacttcttccagcgtgtggtcggtgttcatatcgataccgaaacgcatacgcagaactttcgcttcacgggcggtcaggccagccagtacgtcatgggtggcggcacgcaggctctcggtggtggcagaatccagcggcagctcgagggtggtatcctcgatgaaatcacccagatgcgaatcttcatcgtcgccgattggcgtttccatggagatcggctctttggcgattttcagcactttacggattttgtcttccggcatcagcatgcgctcggccagctcttccggcgtcggctcgcggcccatttcctgcagcatctggcgggagatacggttgagcttgttgatagtctcaatcatatgcaccggaatacggatggtgcgcgcctgatccgcgatggaacgggtgatcgcctgacggatccaccaggttgcgtaggtggagaacttgtaaccgcgacggtattcgaacttatcaaccgctttcatcaggccgatgttgccttcctgaatcagatcgaggaactgcagaccgcggttggtgtatttcttggcgatagaaataaccagacgtaagttcgcttccaccatctctttcttcgcacgacgcgctttcgcttcgccgatggacatacgacggttgatgtcttttacctgctcgatggtcaggccggtctcttcttcaatctgctgcagtttttgcaggccgcgctgcacgtcttctgcaacttcatgcagtttttcagaccacggcttgttcatcgcgatagccgcgttgagccaggtttcgctggtttcattgccggtgaaaagggtgatgaagtttttcttcggcattttgcactgttcaacgcacagcttcatgatcaggcgttcctgggtacgcacgcgatccatcatgacgcgcatgctgttaaccaggtagtcgaactgtttcggcaccaggcggaactgcttgaatacttcagacagcttcaggatctcttcctgagcgctggcgtgcgtgcggcctttggctttgatggtgtcgcgggtgaccatatactgcgtacgcagctcggcgaacttctcacgcgccagttctggatcgatgctgttatcgtcgtcgctgtcgtcttcttcttcatcttcgtcttcatcgtcgtccgccatctcttcggtggacaattcagaaccgacatgcgtcgcggtaggggccagatcttcttctgcgttcggatcaacaaagccggtgatcaggtcagacagacgcgcttcttccgcttccacgcgatcgtactgctccagcagataggtgatcgcttccgggtattcggcaacggaacactgaacctggttgatgccgtcttcaatgcgtttggcgatgtcgatttcgccttcgcgggttaacagctcaacggtacccatttcacgcatgtacatgcgcaccgggtcggtggtacgtccgatttcagactcaacgctggacagcacctgtgcggcagcctcttccgcatcttcatcggtgttgttcgagttttcagcaagcagcagatcatcggcgtccggtgcttcttccatcacctggatgcccatgtcattgatcatttggatgatgtcttcgatctgatcggagtcgacgatatcttccggcagatggtcattgacctcggcataggtcagatagccttgctccttaccacgttggacaagaagtttcagctgtgactgcgggttttgctccataagacggtatccacacttaattcatgagggttggtgtcggtcggcgaaactaagccgccaacataagctaatgagggcttacttatatttttgccgctgcccttcaatgcggctgtcggggtcttcccgaacgatactcggcacttaagccgttaaattcatttgcgggcgcgcgcttctgtaatgacgcgcacctcttcgcgctccgctggcgttaacccgtgggtccgcgagcgggcgatcaattctgagagccgaagctcaagtaccgagtcgaacatgtggttcagcgagtcggtgaacgttttttctgcaatgtccttatcagctatatcgtcccacatggacagcttttcaagggtggcggcttcatttgtgccgcgatactgctctaacagctggccggtggtcaggccaggctgtgacaaacaagtgttgaccagttcggcaaataagccaagtccgggcaatttttcctgattcagaccttccagcggcggcacaagcggtgccagctcgggattctgaaccagcaatcctatcagtatacgcatggttgtgcgttttagctgaggcacaggtcggaccgcgccattttcggattgtttgggcattaaacgttcaagttggttatcgtcaagaatgcccagtttgttacctaattcttgccgtaaatagatacgaagtgtttcacccggtacctgagtaatcagcggcagcgccagcgtactgagctgcgcgcgtccatcgggcgtgctcaaatcgacctgcggcatcaggctgttaaacaaaaacgtggagagcggctgagcctgctccatccgcgcttcgaacgcctctttaccctctttacgcaccagcgtatcgggatcttcgccatccggcagaaacataaagcgtaactgacggccgtcggtcataaacggcagcgcggtttccagcgcgcgccaggcggcttctctgcctgcccggtcgccgtcgtaacagcaaatcacgctgttggtgacgcgaaacagcagctgaatatgttcagcggttgtggaggtacccagcgaggcgaccgcataattaatgccgtactgcgccagggcaaccacatccatatagccttcgacaaccagcaagcggggcggttccgcattatcctgctgggcttcatacaggccgtacagctggcggcctttatggaaaatatcggtttccggggagttcagatatttgggcgtgtcgtcgccaagcacacgaccgccaaaaccgatcacccgcccgcgcttatcgcggatcgggaacatcacgcggtcgcgaaaacggtcgtaactgcgtcccttatcgttggtgaccagcatgccggcatcggtcaacgactgacgattatcctggttgccgccaaaacgctttaacacgttgtcccagccgggaggggcaaaaccaatggcgaatcgtgtgatgacatcgttgcttaatccgcgcgtggccagatactggcgggcacgctcggcgacaggctgcaacagggattgttgataaaacgtgttcaggccgtccattaactgatagaggctttgccgctgatggcgctctatctgggtcagcccgctgcctgcttcaaaaggcacgtcgagattgtgcatggccgccagttcttctacgctttccacgaactcgagcttgtcgtagttcattaaaaagtcgatagcattaccgtgcgcgccacagccaaagcagtgataaaactgtttctcaccgtttacggtgaaagagggggttttttcgttatggaacggacaacacgcgtgataattcttgccctgctttttaagcgtgacccgtgcatcgatcagatcgacgatgtcggtgcgcgccagcaggtcattgataaatactcgtgggattcgtccagccatgtgccccattaccctcagcgccaggcgttcaggtatgtcagatcataaacgaaaataagccgcgcattcctttcggaagcacggccttacaactacaactcagtctgtaaaattgagagcttaagccctcaatacattagtacagacgagtacggcgtgcgttttcgcgagccagtttcttcgcgtgacgtttcactgcggaagctttagcgcgtttacgttcggtagtcggtttttcatagaactcacgacgacgaacttccgccagaacacctgctttctcacaggaacgcttgaagcgacgcagagctacgtcgaacggctcgttttcacgtactttaattaccggcatgtgcctctcacctttgattaaatcggtttgccgctggcatcaacgccagcttatttcaaaatggtgcggaattttactgcaaatgctgctgctttgtaaagcaccgctacccttctttgcaagggacttttgtaagggggacgagtatacacgaactggcaagacggggtgagcaaagttttacaagcatgggcattcgccctacactgcgcggtattgaaaagaggtagaaaccaccatgcgtgtactgggtattgaaacatcctgcgatgaaaccggcatcgccatttatgacgatgaaaaagggcttttagccaaccaattgtatagtcaggtgaaattacacgctgactacggcggcgtggtgccggaactggcatcccgcgaccatgtgcgcaaaaccgtgcccctgatccaggcggcaatgaaagaagcgaacctcagcgcgcaggagatagatgcagtagcctataccgcagggccgggtctggtaggggcgttactggtcggcgcgaccgttggccgttcgctggcctttgcctgggatgtgccggccattgccgtgcatcatatggaaggccacctgttagcgccgatgctggaagacaatccgccggagttcccttttgtggcgctgctggtttccggcggacatacccagctcatcagcgtgacgggcatcgggcattatgaactgctcggcgagtcgatcgatgatgccgccggggaagccttcgacaaaaccgcgaagctgctggggctggattatcccggcggacctatgctgtcaaaaatggcggcggcaggcacggagggacgctttacctttccgcgcccgatgaccgatcgtccggggctggatttcagcttctcgggcctgaagaccttcgcggccaacaccattcgcaacaacggtaacgacgatcaaacccgcgcagacatcgcccgtgcgtttgaagacgcggtggtggatacgttgatgatcaaatgcaaacgcgcgctggatcagaccggcttcagccgtctggtgatggcggggggcgtaagcgcgaaccgcacgctgcgcgcaaagctggccaatatgatgcaaaagcgccgcggcgaggtgttctatgcgcgtccggagttttgcaccgataacggcgcgatgatcgcttatgcgggtatggtcaggctgaaagcaggaacgacggcggatctgggcgttacggttcgtccgcgctggccgctggcagagctgcctgcggcgtgatgatgcatgccggatgaagctcatccggcataaaaactactcttcggtattatccctttcgcgctttttcctgaacttcgtccagatttttgtctcctgcctgcgccacagacgctggatgttgtcatggtgccgcaacaggatcagacaggagagcatggccaccgggaaggtaaactgcggtttaaaccaccagacgtaaaagggcgcaatcagcgcgctgataatggctcccagcgacgaatagccgctaagtaacaccgtcagcagccaggtacccgccatgacgcccgtcaaatcccagccaataggcgcgatcgccccgaacgcggtggcgacgcctttaccgccctggaaatgaaagaagaccggccagatatggcccagacaggcggcaatcgcgataagccccagccagaacggcgtgatgcccaatgcatacgcgccccagacaggcagcatgcctttgaggacatcgaagatcagtaccgttacggctgctcccttgccgccaattcgcaggacgttggtcgctccgggattcccggatccgctctcgcgagggtcaggcagacccgcgatgcggcagaccagaatggcgctggagattgagccgcaaaggtacgcgaggaggatcattccaggcgcgattgcactcataacgctgttccgttttgaaaatgtcgttttattctctgcatctgtggataatacgcataattttttgaaagtggtatccaggttagctaaaaaccaggcggggcgtgatggacattgtatttatagagcaactttcggtaatcaccaccattggtgtttacgactgggaacaaacaatcgagcagaaactgatgttcgatatcgaaatggcgtgggataaccaggctgccgcgaaaagcgatgacgtaaacgactgtctgagctacgccgatatcgccgacacggtgattggccacgtggaaggccagcgttttgcgctggtggagcgggtggccgaggaagtggcagagctgttactgagccgctttgcgtcaccctgggtacgcattaaagtcagcaaaccgggcgcggtagcgcgggcggcaaacgtcggcgtgatcatcgaacgtgggcttaatccgaaacaaaacaattaacttcataattattaaaccaaatgccagtataccggtctgatgtcagggcctgacgcggcttcgctggcgagccgaccgttttgtttactttttaggggtttaattgatgagcgatatgcactccctgctgattgcagcgattttgggtgttgtcgaaggactgactgaatttctgccggtatccagtaccggtcacatgatcatcgtcgggcatctgcttggatttgaaggcgaaaccgcgaaaacctttgaggtggtgatccagttaggatctatcctcgccgtggtggtgatgttctggcgacgtctgtttggtcttattggtattcactttgggcatccgccgcacgagggagagggcaaagggcgcttaacgttaatccatattctgctgggtatggtgccagccgtggtgctggggctgattttccacgataccatcaaatcgttattcaacccgattaacgtgatgtatgcgctggttgtcggcggcgtgctgctgattgccgccgaatgcctgaagccgaaagtaccgcgcgcggcgggtctggacgatatgacctaccggcaggcgtttatcatcggctgcttccagtgtctggcgctgtggccgggcttttcccgttccggggcgacgatttccggcggtatgctgatgggcgtcagccgttacgcagcttctgagttttctttcctgctggcggtgccgatgatgatgggcgccaccgtgctggatctctataaaagctatcatttcctgtcgatggcggatttcccgatgttcgccgttggctttatcacggcctttattgtcgcgctggtggcgataaaaacattcctgcaaattattaaacgtatttcgtttattccctttgccatttatcgttttatcgttgcaggcgcggtatatctcgtctttatgtaatttcagacgctaataagccccgccactggcggggttttttatttgtctgaataatgctttccccttcccttagttttgctaaaaaagcaattaactttacagccttaactattaggtttaaaccagccgtgcttatagttaagcagagctaatacttttaactttagggataaaggaaaggtgtacctatgcaattaaataaattaactgcggcgataatattgtctgtcgctgggctgccaacgctggcttatgctgcaaacgtaacaggaaatgacgacaccaacagtttttccgggctggatgcctggatgatgatctcaaaagataatggctattcctggcaggcctataccgacagcaagcagaataatttccccggtacggtggtaggactggtggcgcagaaacaagaactggccattatttcgcacccttatgatccaaacagaacctatcgtggcggcgaaactgtgcgattccttgactattactggacagcgcagtggtgggtggataaaggcattagcccgtcaaccgatccggtctggaaaaagggtgataaggtcgattttaatatctacgcggaattctatttcacaccttataccggtcagaaagcgaaagatctgcaggcaacagaaaaagcaaaagtcgcggcacagcgcaaagtcattggttatttcccggaatggggcatctacgatgcgcacaaaaactttactccggataaaattgactacgccgggctgacccacgtgaactatggctttgcggtgattaaagatggccgggttgtcacccatgacacagaacgggggccggatttgatgcgcaatctcgatcagcgtacagaaatggccggtgtcacccatatgatctctattggcggctggactaactccgctgaaggagtatttgaagcggcaactgccaccgatgccggtattgaaacgctggctgacagcatggtgtcctatatgcgcacctggcgtttcgatggtatagatgttgactgggagtacccggatagcgacgctgaaaaaaaccagttcaccaaactcatccagaaattgcgcagcaagctggatgcagcaggtttgcaggatgacaaatactatcagctgtccactgcggcaacgaccaaccacaaaaatatcaaatacattaacccggaagtcaccgcgccgttactggatagcgtcaacgtgatggcctatgacatgcatggtgcctttgatccgatcaccggccacaacgcgccgctgtttgccaacagtaaagatgccgatccaaaactcaattcttcctcggcgatgatggaatacgccaatacctggaaagtgccgaaagcaaaactgatgatgggcatcccttattatgggcgtggctgggggaatgttgcgccgaccgaagtggtgaaaggtttgccgggcttcctggtaagcggcaccgcaaccgtgaaaggcgcatgggatgacgcaggtcagtttaccggcacgaatccatggtatgtgctgaaagaaaaactggcgagcggcgaatatgcgcgttactgggatgcggaatcccatgttccctatctttacagcaaatggaacggtgaattcctgacctatgacgatccgcagtcagtgcaggataaagtaaattatattcagcagcagaatttcggcggcgcgatcatctgggatctgagcggtgatacgccggaacatgagttaggccatattgtcgatgatattctggacaatacccaaccggtaccgggcaacggcgtaaaagcaacgctgttcagggatatgaagttcaaaggcgcgaagctggacgtaaaagaggacattccttgtctgacgaaggtttacgactctgcaaatcattcagcaaatgatatgacgtcttcaatcaacgttgggccaggttcattagggattaccatcttcagtaactgtgagtatacgggcactaaaaccatgatcccggaaacggtagaggaaatgccgtcgtggttaaacgataaaacctcttcggtaaaagtggtcaaagcgctggcgtttaaagacgctgattttagcggcctgagtctgacggttgaagatgacatgcctgcactgaccggcgatgtgagctttaacgatatgatgtcgtccattaaagtggcggaaggctactcggtacgtctgtatagcgataccggttacagaggccgatatattgaagtgaagggcggtcagaatatagcaaatatgagttctgtgaatatgaatgacaacgtttcttccattggcgtaactaaaacgaactgataaccggcccttttctgtccggaaaagggccgttaagcaggatttaagacgcgtccggcagcatatcgccggacgcttttttccacgcctctaccgccgcaattcgccgacgggtcagctcttcacgaatggccgggccgctaaagcctgcgtcaatcacttctctgtttgtcacctgttgcgccgctttccaggcgtcacgcagcagacggccctggtaataatccgtggcttcaaaggtggttctgccgcgcacatcggcttcgctggtgagcgcgatctgctccacgcgctgcggcttgcgccaggcgtcaatggtgtcaaacagcttgacgatggtctgcggtttaaggatgggcagggtgtggatcagatcgtgatattccgccacgagcttcgccagatcgcgcagctcgttgggtacttttaagcgcgcgcagagattttccaccagcttcacacctgccggaccgtggccgtgatggcgcggccagaggtgtttcggcgttaaccctttgccaaggtcgtgacacagcgtggcgaaacgtacatccaggtccgggctgagcatcgccgccatggataaggtcatcagcacatgaatgccggtgtcgatttccgggtgccattttgcgggggcgggcacgccaaacaggatatcgagttccggaaacaggaccttcagcgcaccgcactcgcgcagcgccataaaatagacctgcggattacggctgctgagggcgttttccgtttccttccatacacgttctggcgtcaggtgttccagctcacctgcggcggtcatctcgcgcattaacgccatggtttcatcggcaatacggaaactcaaatgggcgtagcgggccgcaaagcgcgccacgcgcagcacgcgcaggggatcttcattaaaagccggggaaacgtggcgcagcacgcgcattttgagatcgcgaaggccgttatagggatcaatgatcgtgccgtcatcatcctgcgccatcgcgttaatcgtcagatcgcggcgcagcagatcctgctccagcgtgacgtctggcgcggcatagcagctaaagccagtataaccaaaaccggattttcgctcggtgcgcgccagcgcgtactcttcgtgagatttgggatgcaggaacaccggaaaatcacggcctacctgctgatagcccgcgtcaagcatctcctgcggggtggcaccgaccaccacccagtctttatctttaaccggtagctttaacaacgcatcccgaaccgcaccaccgaccagataactcttcacaccgcttccccatggttacattcccgttaatgatacgtaactccggggaagatggcgaatcggcgtcagctcatccagcggtctttgcgtttccggcttgggatcatgtgcggtaacaccagaccgagcagcaggcccgcgcccagcacgccgccgccatacataaaccactgcatgatgatcgaacgctgtttgtcatcgatctgaagattggcggcatccactttcttctgcgccacaatcagttcgtttttaagcttctggttttcctgcttcaggccgttgatcacgccgtcgctctgcgccactttctgctgcatttcagccgtgcgctgattccaggtgttgtcgatgttggtcagtttatcggtcagggttttgacctggttttccagatccggtacgcgggtgcgcaggctgggggtgctgttcagttctttttgcgggatccacgcggtgcggccactgctgtcacgcacctgcgcataattggtattgttgtcggtctgtaacaggacaacttcttcaccggcgttcagggtacccagcaggcggtaattatcacccgggccgctgcgtacccaggtgttcagttcatcagaaacgtaacgcttttcttcggcgtgagccacagtagtaacgctaagtgcgaataaggtcagtcctatcaggcgtaattttggcatcaggcagtcgttagtgtcataaaaaagtggaacgatagtagtggcatcagtctgacgaggcaaagtattcggcatcaataagaatcatccaggtcaaacctgccacttctgcgaatttttcaggccgccaatgtctcacagaatggcaatttggcgcaaaatactatctactgacaaacatcaaacgggtaagttcgccgaaattttcactgttgtgacataaccataagtacaagaccatggctcaagaaatcgaattaaaatttatcgttaatccacagaacgtagaaacgctgcgcagccacctgcacacgctgaccactgagcacgttgcgccgacaaaactgctcaatgtttactacgaaacgccggataactggctgcgtgggcatgacatggggctgcgaattcgcggcgtcggcgatcgctatgaaatgacgatgaaaatcgccggtcgtgtggtgggcgggctgcatcagcgcccggaatataacatcgacattgatggaccggagcttgatctggcgcgcttcccggcggaagtctggccggaaggcggcttgccggaggatttagccgcccgcgtcagcccgttgttcagcaccgatttcgagcgggaaaagtggctggtgaatgtcggcgacagccgcattgagatcgcccttgatcgtggcgaagtcaaagccggcgagtttcaggagccgatctgcgagctggagctcgaactgctgagcggcgagcgtgacgacgtgctgaagctggcgcaccagctggtgacgcagtccggtctgcgtcagggcagcctgagcaaggcagcgcgcgggtatcatctggccgcaggcaatgccccgcgcaggatcaaacctaccggtattctgccggtggtgccaaaagccaccattgagcaggggcttgaagccgccctcgaaatggcgctggcgcagtggcagtaccatgaagagctgtgggtgcgcggcgagggcgcagcgaaagaggaagtgatgaaggcgatcgcgctggttcgtcacgcactgacgctgttcggcggcatagtgccgcgaaaagcgagcgctcacttacgtgatctgctgacccggactgaagccaccatcacttctgccgtatccgccgaaaccgcggtgtacagcaccgaaacggcgaaggcgaaactggcgctcaccgagtggctgctgacgcgcggctggcgtcctttcctggatgcgaaaggcgaggcgaaaatcggcgactcgttcaagcgttttgcggatacccatctttcccgccacgccgccgagctgagaaccacctttgcgcatccgctgggcgatcgttatcgcgaccagctgccgcgcctgtctcgtgacatcgacagtgtgctgctgatgtccggcttttataatgaggtgcaggctaaggcgtggattgagaactggcaggggctgctgcacgccatcaaaaccggccagcatattgaaattgaacatttccgcaacgaagccaacatgcaggaaccgtactggctgcacagcggaaaacgctaacccaggcaaaggatcaccgcgatgatgccgctttcctcatccttacagcaacactggcagacggtagttgaacgtctgcccgacgcctcccttagcccgcaggcgaagtcggtgctcactttcagcgattttgtgtgcgacagccttatcgcccatcctgactggctgacggcgcttgaacatgagcccgtcagagcggatgagtggcgggagtatgctggtttgttgcagacgacgctttcacaggtgcaggatgaagccagcctgatgcgcgagctgcgtctgtttcgccgccgcatcatggtgcgcatcgcctgggcgcaggcgctgtcacagatttcggatgaggacatcctgcaacagctgagcgtgctggcggagacgctcatcgtcgccgcccgcgactggctgtatgacgcctgctgccgtgaatggggcacgccgtgcagccaggaggggcaaccccagccgatgctgatccttggcatgggcaaactcggcggcggcgagctgaacttctcctcggatatcgatctgatttttgcctggccggaaaacggcgtgacccgcggcgggcgtcgcgaactggataacgcgcagttcttcacccggctgggacagcggttgatcaaagtgctcgaccagccgacgcaggacggctttgtctatcgcgtggatatgcgtctgcgcccctttggcgacagcggaccgctggtgctgagctttgccgcgctggaggattactaccaggagcaggggcgcgactgggagcgctatgcgatggtgaaagcccgcattatgggcgacaacgacggcacctatagcaacgaactgcgcgccatgctgcggccttttatcttccgtcgttatatcgacttcagcgtcatccagtcgctgcgtaacatgaagggcatgatcgcccgcgaagtgcgccgccgtggcctgaaggacaacatcaagctgggcgcgggcggtatccgcgaaatcgaatttatcgtgcaggtgttccagctgatccgcggcgggcgcgagccgtcgctgcaatgccgcgcgctgctgccgacgctgacggccatcgaccagctgaatctgttgccgcccggcgatgcgaactccctgcgtgcggcctatctttatctgcgtcgtctggaaaacctgctgcaaagcatcaacgatgagcagactcagaccctgccgggggacgatctcaaccgtgcgcggctggcgtgggggatgaacgcgccggactgggacgggctgatgcaaagcctggcgacgcacatggcggcggtgcgccgggtgtttaacgaactgatcggcgacgatgaatccgcgtctcctgatgaacagctgtctgagcaatggcgcgagctgtggcaggacgcgctgcatgaagaagacaccacgccagggctggcgcatctgtctgacgacgatcgccgccgcgtggtggcgctgatcgccgacttccgtaaagaaattgataaacgcaccatcggcccgcgcggtcgccaggtgctcgatcacctgatgccgcacctgctgtgcgaggtctgctcgcgggatgacgcgccggtgccgttgtcacgtctgacgccgctgctgaccggcatcgtcacgcgcacgacctatctggaactgctgagcgaatttcccggcgcgctcaaacacctgatctccctgtgcgccgcctcgccgatggtggcgagcaaactggcgcgttatccgctgctgctggatgagctgctggatacccgcacgctgtaccagccgacggcgatggacgcctatcgcgacgagctacgccagtatctgctgcgcgtgccggaagaggatgaagagcaacagctggaagcgttacgccagtttaagcaggcgcaaatgctgcgcgtggccgccggtgacatcgccggtacgctgccggtgatgaaagtgagcgatcacttaacctggctggcggaggcgattattgacgccgtcgttcagcaggcgtggacgcagatggtggcgcgttacgggcaaccgactcatcttcaggatcgggaagggcgcgggtttgcggtggtcggctacggcaaactcggcggctgggagctgggctacagttccgatctcgacctggtgtttttgcatgactgcccggcagaggtgatgaccgacggcgagcgggaaatcgatggccgccagttctacctgcggctggcccagcgcattatgcacctgttcagcacccgtacctcgtcgggcattctctatgaagtggacgcccggctgcgtccgtccggcgcggcggggatgctggtcacaaccgcagaggcttttgcggattatcagcagcacgaagcctggacgtgggagcatcaggcgctggtgcgcgcccgcgtggtgtacggcgatccgctgctgaaaacggcattcgacaccattcgccgcgaggtgttgatgacgccgcgggaaggcgaaaccctgcaaaaagaggtgcgcgagatgcgcgagaaaatgcgcgcgcatctggggaataaacataaggatcgttttgatctgaaaaccgatgagggcggcattaccgatattgagtttatcacccagtatctggtgctgcgccacgcgtgcgacaagccaaagctgacgcgctggtccgataatgtgcgcatccttgaactgctggcgcagaacaacatcatggatgacgacgaggcgcaggcgctgacgcaggcctacaccacgctgcgcgatgagctgcatcatctggcgttgcaggaacaacctggccatgtggcgtggtcatgctttatggaagcccgtcagcaggtcagcgccagctggcagaagtggctggtggaaccgtgcgcttaaccgccagtgtggtattatcgcgcgcaaaatttttgaaattgcctggagtctggaatgaaagtaacgctgccagagtttgaacgtgcaggtgtcatggtggtcggtgacgtcatgttggatcgctactggtacggcccaaccagccgtatttcaccggaagcgccggtgcccgtcgtgaaagtggataccatcgaagaacgtccaggcggcgcggcgaacgtggcgatgaacatcgcgtccctgggggcgaactcgcgcctggtgggcctgaccggcatcgacgatgcggcgcgcgcgctcagcaaaacgctggctgacgttaacgtcaaatgcgattttgtttctgtacccacgcatccgacgatcaccaaactgcgtgtactgtcgcgcaaccagcaactgatccgcctcgactttgaagaagggttcgaaggcgttgatcctgagccgctgcatgagcgtatcagccaggcgcttggcaacattggcgcgctggtgctctctgattacgccaaaggcgcgctgacgacggtgcagcagatgatcaccctcgcgcgcgatgcgggcgtaccggtacttatcgatccgaaaggcaccgattttgagcgctatcgcggcgctacgctgttaacgccgaacctctccgaatttgaagcggtggcgggcaagtgcaaaagcgaagaagagatcgttgagcgcggcatgaaaatcatcgccgattttgacttctccgcgctgctggtgacccgctccgagcagggcatgacgctgctgcaaccgggcaaagcaccgctgcatatgccgactcaggcgcaggaagtgtatgacgtcaccggtgccggtgatacggtgatcggcgtgctggccgcgacgctggcggcaggcaacacgctggaagaggcctgctatttcgctaacgcggcggccggtgtcgtggtcggtaaactgggtacctctacggtatcccctatcgagctggaaaacgccgtgcgcggtcgttcagaaaccggcttcggcgtgatgaacgaagaagaactgaaacaggccgtggcggccgcccgcaagcgtggcgaaaaagtggtgatgaccaacggcgtgttcgacattctgcacgcgggccatgtctcttatctggcgaatgcccgtaagctgggggatcgcctgattgtggcggtaaacagcgatgcgtccacgaaacgtctgaaaggggaaacgcggccggtcaacccgctcgaacagcgcatgatcgtgctgggcgcgctggaagccgtggactgggtagtgtcctttgaagaagatacgccgcagcgcctgattgccggtattctgccggacctgctggtaaaaggcggggattacaagccagaacagatcgccggtagcgaagaagtatgggcgaatggcggtgaagtgatggtgctcaattttgaagatgggtgttcaaccaccaacatcatcaaaaagatccagaaagacagccagtaagacgaattgcccggcagcgcgacgctggccgggcagtgtcttttatttctgcacgtccgtgtcgacatctaccacgtcaaccggcggaatggccggagccggcttcacttcttctgtggtgtggcgattttccagatcgctgatgcgttgctccagcagcgccagcttctcgcgggtgcgcagcagaacctgagtctgcacatcgaattcttcacggctgaccagatcgagacgcgtcagttgcgattgcagcgtctgacggatttttttctcgacgtcttcgccaaactcgcgaatgcctttcggcatggactcgtgaacctgacgggcaatctgttcaattttcttcgggtcaatcatagtcgttccctgttcgtgtgggtaatagcatacattgtagcgtgttaagcgcagtgttaaaccagatttgtttaccacacgggcattgccgccaataatcaatagcgttatagttattgcgcttattctcagggcggggcgaaattccccaccggcggtaaatcggcagctacgccgaaagcccgcgagcgcttcagatgcaaatctgaaggtcagcagatccggtgtaattccggggccgacggttagagtccggatgggagagagtaacgatccagacgggcgaggcccgttcacgttatttttttgccgctgtgcggtactcctaagactgccctgattctggtaaccataatgttaatgaggtttttttaccatgaatcagacgctgctttcttcttttggcactccttctgaacgcgttgaactcgcgttaaccgcactgcgcgaaggccgtggggtaatggtgcttgacgacgaagaccgtgaaaacgaaggcgatatgattttcgccgccgaaaccatgaccgttgaacaaatggcgctgactatccgtcacggcagcggcatcgtatgcctgtgcctgaccgacgagcaccgtaaacagctcgacctgccgatgatggtcgaaaacaacaccagcgcttacggcaccggttttaccgtgaccatcgaagccgcgcatggcgtgaccaccggcgtttctgccgctgaccgcatcaccactattcgcgctgctatcgccgatggcgcgaagccgtccgatcttaaccgtccgggccacgtattcccgctgcgcgcgcagccgggcggcgtgctgacccgtggtggtcacaccgaagcgaccatcgatctggtgtcgctggccgggtttaaacccgcaggcgtgctctgtgaactgaccaatgatgatggcaccatggcccgcgcgccggagtgcattgcctttgcgcagcagcacaacatggcggttgtcaccattgaagatctggtggcctaccgtcgtgagcatgagcgtaaagccagctaagcgttaaaaagccgaataaaaaatccgaagtcagtttcctggcttcggatttttgcattttaacgctccgctattttccccggctaagctttattccccaggcaacactcataattactagcaggataaagcaggtgccaaatgccagcaggcaggcctgcgccatgttcatgaaatgccatggcgggatcagataccagccttccgactgctgatacagatcgataaaccatttctgcacgctgctcagggtcacgccatccggtactacgggcgcatcataaccgcagtcgccggtgggtttaaaccactccggcgcccaggacgccagcggcaaattaaacggaaaggtgggttccgttgagcatccctgaacgccaaaaagcgcgtccggatccgggttatgcaccgcgtaatgaatgccgttcagcttgatggcatatttcatccctatgatgctgccgtaaaacgccgccacgcagcccgttaacttcagcacaaggtttttagggttaatggccgcgactatccccccgaataccatcacgaacatggcgaaacggatataaacgcactgctcgcagggagccatgtagagatagatctggaaaaacgaatgcgccagaacgatcagcccacccatggcagccaccattaacagccataaaaagcgcgtctcctgccagcggactaaggtgtccaccggcgaggtttttagcgagcgccataatcccttaaggaaattcataggcactatccctgtttagccgccagctctttgatgagttcagccatggagtcgatggattttatatttttggtgtagataaggtatttaccgttcaccacgtaagccggaacgccctggattttggccacgtcatagctggctttccagcgttcgtagagcgcctggacctccggtgttttaacggtttcgtcgaattccgcgcgggtcatgcccaccgcttccagtcccgtcttcaggaaatcatccgcaccgccatcccaccgctctttcttatcgtggtaagcctggtaataagcaaatttcgcctttttaaacagcgacttctcatctaacagcgacgtacccgccgcctggtctttcaggatcaaaatggcaaataattcgctggcctgtttgccgtatttccctttggtttccaggtggaagggggtaaatgctgccacatcggcgacttttgcagaaaccgggccggtgacggctttgtcatatttataacaaaacgggcagtcgtagctgaaaaccttaattaaggttttatcggcattggggatcggtttttccagcacctgataatccgtgccttccgtaaacgccgatgccataaagggcatcatgagcgcggataacaccactgcgctacgcagcagagccttaagatatttagtcagcataatcattccttaattaacagataaaatgcagcgcatcacttaaacatattctgcggatgcatcatcagcgcgcgataatgagtctggttaggtttgtcagataacacatcaatttcgactttaacttctttggtcttatagtcgatttcattcagcttaccgatagtgggctgaccgacgtcaaacaggtgaatggaaccactgaagccgaacatagtgtcacggtctttctgatattcaatgaccgaggtgatggggctgtaaaaatcatatccccgatctttgccgtattcccacacttgctgcaccgtcatgtttttctcgtcaattttgtattccacaaagcgcgagtatttcatggtgggcagagcgggttgctccagaccacggccatcgccattatcaaagaccgtcagggtgcctttgctggacaaccaggcggtatgctgggtataagcgaaatcaaaatcggtgttctggcacttgccgttttcatcgcaggtgagcggtttgccatctttccccacgggtttcagcaatttaggcgcaagcttttcgttccagccttttgacggcgcgaggatccatttcacctgcttgtcccggccgattttcaccacgccctgatgacgggaggagagaataatcgagtcatctttggcatcgtaggcaatggagttcacgtgcgcccagttgcggcccggccccacgcctaacgcatcgccatagggcgtatcaggctccagcttcgcctgctgcccggcatgtttcagatcgacgttaacgcataccgccccggcgtccagcgcgcccagcagactgtcgcgcaggggatcgaggattttattcagatcccagacgtcaaggacgcgtccggacttgtccacttcgatgatgtgatcgcgaatggtgtgaacatgcagcccgtcatcgcgcttgtagttgcgtttgcccacgcgcagtaacacggtgcctttaggcgtttccagcgactcgtgggtggcgtccaggaagccgcgcggtaatttatgatcttccagcacctggccgagcatatcgaattcataccagtgctgaccctgcaccgccgtaaaggtgccgcgcggcgtttcgcggatccccatcagatagccgcgtttattaatatcgacatctttgccgtcatagagcgcgtcctgctccagccaccagcggtattccccctgggtgtccactacaaaagtgaagggggcaatatcgaacggcagcgcgccgcctgcgggaccggcatcaaggatctccgcatttttatctttttcgccatgccagtgcagatcggaaccctgcggcgtaaaggtgtgggtattcaccatataaaggcgatcttcaaaaccgggagcgactttaatcactttggtttgttgcagatcgctgaaggaacggttatcgacataatggttcacgatagcggatgtcgtaataacgtaatcctcttttacgggtttaccgttttctttgtactccaccgtgaccttattattgtatttttgatataaaccaaaaaccggaatgccatcgtaattcctgagtgacgcggcacccacggcatagctgatgggcacgcctttttcccctttgccatgcaccgtaactttcacatcggaaatgttatggctgtcgagggaaattaacgcggtgagcggggcattaccgtaggggtcgacaatgactgaacctaattttcctgccggtggcgcaggctgaaatccggcggcgagggaactggcggttgtcaggctaaaggataatgccatgccagcgattaacagcttctggtagggtttgagcataataaaattccttttttgacgactttaatcattcataataaatatgattttgccgtttattgagcggagttatactttcatgattaatagcgataccgaatctgtggtgagtaataatatgtatgaactgcacagtgataataagcctgtgcgtgcgcgggtaaatcatcctgataaaattatgtgagccgcttccatagcttttatttttaagaatatataaagatgtttattgctgttagcaggtgtttatatgatcggtatcagtttataagcgtaaaagtctgtcactatgagaaaatatgcgcgtcgaaagcctccgcgcgaaagcagattatcaggagagtaaaaatgtttatcgcatggtactggctggtgatcatcggcgtggcaatcctgggctacgtctgtcatataaaacgctactgcgccgcctaccggcaggacagagacgccctgctggcagggctgcaaaagctcagccagagtaaaaaaggaaaagaggggaaagctgccggacagcctccggcagccgcagagaaagacgcttagcccacgcccagaaactgtagcagcaccaggctcaggcccatcaccgacatgccgcacagcacgccgtagctggggttgttgttggggtcgatctcttttgccagcggcatcagttcatccaccgacagagcgaccataatacccgccaccgccgccatgatcgccgccattaatagcggtgaaagcaggctgccgaggatcagccacgccagcacgccgccgaggatctccgccagtcccgagatacccgcccagaaaatggcggtacgcttagagccggtggcggcataaaccggcccggccaccgccagcccttcaggaatattgtgcagcgctacggcaagggcgatgccaaagccgagttcaagattgttactcgccgtcacataggtggcgatcccttccggaaagttgtgcaggctgatgccaagggtcagcaggatcgccgtgcgcctgaggttacgcggcaatggctcgccttctgtggcgggcagcagatcctgtggatgggcatgaggcagcaggcgatcgagggcaaagtagccgagcaggccgacgataaacatgccatagccgagaacgggtggcatatccggcgtagctaaggccgcaggcagcatctccatcaaagaaattaacagcatgatgcccgcggcaaaccccagtgaaaaagccagcacgcgattggagggcttctggcccattacgccgagaatggcgccaataaaggtggccgcgccagccagtaaggtcaggatcaagggaactgacattaacaactccttgtgataataattctcatttatgttaatgaggatttaccgccaacgcgagcgggtcattcgtcctttacgcatttcttacattcaaaattcctgatgatcttcatcatggttatctgcgtttatccgcttcggaaacagcgtaaggtaaaggcatattattttccgcctttgtaaggatatgaccatgtcagcaccgcgtatgccagcactatttttaggtcacggcagtccaatgaatgttcttgaagataacatttacacccgtacctggcagcatcttggcgagacgctgccgcgtccgaaagccatcgtggtgatctctgcacactggtttacccgcggcaccggcgtgacggctatggcggagccaaagaccattcatgattttggcggttttccgcaggcgctgtatgacacccattatccggcccccggctcacctgcgctggcgcagcaactggtggatctgttagcgccgatcccggtgacgctggatcaggaagcctggggttttgaccatggatcctggggcgtgctgatcaagatgtacccgcaggcggatatcccgatggtgcagctcagcctcgacagcaccaaaccggcggcctggcattacgaactggggcgcaagctcgccacgctgcgcgatcagggcatcatgctggtggccagcggcaacgtggtgcataacctgcgcacggcgcgctggcacggcgaaaacacgccttacccgtgggccgtctcatttaacgattatgtgaaggataatctgacctggaaagggccgacggagcagcatccgctggtgaattatcttgatcatgaaggcggttcgctgtcgaacccgacgccggatcacttcctgccgctgctctacgtgctgggcgcgtgggacggccaggagccggtcactattccggtggaaggtctggaaatgggctcgatcagtatgctgtcggtacagatagggtaaacaaaaaacccggtaagcagaacgccaccgggttttgattattccacaaaaatatgcggatagaagcgcgacagatcctgagtgatcaacgcccgatcttcgcgaatgccgatccccgcaggttgatcgttgataagccagctgccaatcagcacatagctgtcgccgaatttcggcagcgggcagaactcctgcacaatcatgccttcttcgccgtacgggccttccgcctgctcaatggtttgaccgttttcaatgatcgacacgtttgcgccttcgcgggagaaaattggcttcaccacgtacttttcaggcgtcggatgctcatcttcggcaaaccaggcgggcagcagatttggatgatccgggaacatctcccacagcatcggtaacagcgctttattggaaataatacttttccacgccggctccagccagcggacgccagcgtcttccagcttggtggagaacatttcgcgcagcatgtattcccagggataaagcttgaacagattgctgatcacctgatcctgcaaatcgctgaactggcccttttcaccgaggccaatgtcttccatatagaggaattcggtggcgataccggcttcggcggcgcagtcctgcagatattgcacggtgccgcgatcttccacggtatcccggcagcaggccatgtgcagcaggttaaaaccatactggtcgcgcagctcgccgaagcgctcgatcagcttttcctgcaggctgttgaactgatcgctgccagcgggcagattgccggcattcagctgatcttccatccacagccactggaaaaatgccgcttcatacagcgaggtcggcgtatcggcgttgttctccagcagtttaggatcgcccacgccgtcccacgccagatcgaggcgggagtaaagcgagggttgctgcgtctgccaggactggcgcacaaagccccaggtgtgtttaggaatgcggaatttggtcatcagcgcatcgctggcaatcaccttttccaccaccttcaggcacatctggtgcagttccgccgtgacgtcttccagcttctcaacctgtgcgagggtgagcttgtagtaggcgtcctcacaccagtacggctcgccgtacatggtgtggaagttaaagccgtactcggtggccttttcgcgccagtccgggcgctcaacaatactgattctttccatgcctatcagccgcccattgagcgtgaagaggtaccggcagcgctgcgctgcatggtggattgtttagcgactgattcgccgaacccgccgcgggtcacggtggttgtggtggccggtttaggggccagcgcggttttcggcacggtagcggtacggcctggctgtgcggcgccgtagcctttaccggaggcatcggtgtactggccataagccgggctggccgggttgcgtgaggtaaacagcggctgctgcgcgaagcctgcgccgccgcccatcagacgacccatcatataacccgccatcagcggcatccagaagctgccgctttgctgggtttgcgcctggttttccggggccatacctgcctgagcaggggcctgctggcactggccttcgccaaattcagccacacagtcttcacgcgtggcgtatttcggcgcggtacgttcggcttcttttttcgcgttattaaaggcagtggtacattccgcacttttgcccgggttggcgctggtgcagtcgtccgcattttgatacatggataccgtttcgtcgctttgctcgcagcctgccagcataaacacggcagtgacggcaaaggcgaccggcgtcaggtggcgtgcgctccagcttttgcggaacgtcgcatgattaatcgtttttgtccgtttcatagatgtcttccagaacccagagttacagcaaggtgaataatgctcaggatagaggatgagtggtcgaaaatgaagcgcgatcgggccggaacgggtggtgaagagggatctttacgttgtcttacgttgaaatgggggctgacgcccccattgaacagattaacggctaaacggattagcgccgctacgtgaactattggttgccacaggggcgtcagcggtggtcgcggactgtgcgtcggcggcgatgttctgcacgcgcgcatcctgctgtggattttccggcgccacggcttcaggcgtggttgaggtcggtttacccagcgtgctgttcagcgccagcagatcctgctcgttcagcgtaccgagggcggatttaatattcagctggttgatcagatagttataacgcgcgctggaaagctgctgcttggcgttatacagcgccgtggtggcgtccagcacatcgacgatggtacgcgtacccacggagtaacccgcttcgctcgcatccagagaactttgcgcagaaaccacggcctgctcataagccttgatgctgctgatggacgcgttaacgttgttaaaggaggaacgaacgttctgtaccacgctgcggtgcgcggtttcgagctgctcgctggcgccaacgaagttgtactgcgcctgcttcacctgtgagttaaccattccgccctggaaaatcggcagagagaagttcaggccgactttgttctgaccaacgttgctgtcatcaaactgcgcattgttggttttagaaccgctgtacgaggtatcagacacgccggtagaggcggtgagatccagggtcggcaaatggccgtcctgcgcctggcggatctgctcacgcgccaggtcctgattcagacgcgcctgcaacagcgacaggttgcggttttctgcttctttcagcagggcattgaccggctgcggcttgtcagttttgaagttatcgacgttcagggaagccagttccggatagtagttaccggtgacctggcgcagctgctcaacggcgttatccagattgttgcgcgcggtgacttcattcgccagcacggtgtcgtactgtgaacgggcgttctgcacgtcggtaatggcaaccaggccaacgttaaaacgctgcgttgtctgatcgagctggcgatagatcgcctgtttctgtgcttcggtgtaagagagcgaatcaatggcgctcaacacgttgaagtaagcggtggcggtattgagaatcaacgtctgctggtcagtctggaaggtcacatcctggataccagcggctttttcctgcagcgtcagcgcgcgccactttgacatgtcaaacagggtttgtgtaagttgcaaagaggcgctggtggcattggagttcacaccattgctgtcgcggaagccattgctgtaggtgtaatccgcacccaaacccagctgtggcagtaacgggctgcgtgcttcgttgattttctcgaatgcggcatcacggtctgctgcagacctgcgcagttccgggttgcttaaacgcgcctgcttataaacctgcaacaggttttctgcctggctcatggcgctgaaacctgcaaggctcaggccgattaggatggggagcaatttcttcatttgcattccttgttgtgaagcatgatatagcgctgatcaaagagtaaaaataattgccgattctagcagagactagcatgacaaaaggttggcgttacgtgccatctggcgttaatttgcaccaatctaccacaaggtacagtaaacggcagtgctggtgccttgaaatccacaatttcatcattatttaggggcgggatgaatcatgaataaagacaagccggttgccacgactttcaccaaaaatgatgtagaaattattgcacgggaaaaactgtacagtggttttttttcgctcgatttgtaccgctttcgtcatcgccttttcaacggggaaatgagcaacgaagtacggcgtgaaatttttgagcgcggtcacgcggcagtgttgctaccctatgaccctgtgcgcgatgaaatcgtactgatcgagcaaatccgtatcgccgcttatgacaccagcgagacgccctggctgctggaactggtggcgggcattatcgaagagggtgaaaccgttgaggacgtcgcgcgccgtgaagcggtagaagaggcgggccttgaggttggccgcgtgaagaaatttatgagctacctggcaagtccggggggcaccagcgagcggttatcgctgttggttggtgaagtggatgccacagaggccaaaggtatacatggtctggtggacgaaaacgaagatattcgtgttcatgtggtgagccgggaacaggcttaccagtgggtagaagaggggaaaatcgacaacgcagcgtctgtcatcgccctgcaatggctgcagctgcattatgaagcattgagaaaagagtggataaaatgaagcgttacacacctgacttccctgagatgatgcgcctgtgcgaaaccaacttcgcgcagttgcgacgcctgttgccccgtaccgacgcacccggcgaaacagtgagctatcaggtggcaaatgcgcaataccggttaaccattaccgagtccacccgctacactacgctggtggaaatcgaacagacggttccggcgataagctactggagcctgccgtcgctgacggtacgtctgtatcatgatgcgatggtcgctgaagtgtgttcaagccagcagatttttcgcttcaaggcacgttatgattacccaaacaaaaagttgcaccaacgcgacgaaaagcatcaaattaatcagtttttagccgactggctgcgatactgtttagcacatggagcaatggcgattccggtttgttagcgtcgtgaaacctaaggacaccatttggaaagcctgttaaatctggggctggctggtgaggccaacatcaggatcttacaaataaccgatactcacctgtttgctgagaagcatgaaacgctgttaggcgtgaacacctgggagagctatcgggcggtgctggacgccatccgcgcgcaacagcgcgactgcgatcttattgtcgcgacgggcgatctgtcacaggatcacacggctgcggcctatcagcattttgctgacggcatcgcaagctttgatgcgccctgcgtatggctgccgggaaaccatgatttccagcccgccatgtacagcacgcttcaggatgccggtatttcgccatcaaaacgcgtttttgccggcgaacactggcaaattctgctgctcgacagccaggtgttcggcgtgccgcacggtgaactgagcgagtttcagctcgactggctggagcgtaagctggcggatgcgccggatcgccatacgctgctgttgctgcaccatcatccgctgccggcgggctgcggctggctggatcagcacagtctgcgcaatgcgcaggagctggacaacgtgctggtgcgcttcccaaaggtgaaatatctgttatgcggccatattcatcaggagcaggatctggactggaacggtcgccgtctgcttgccacgccgtcaacctgcgtgcagttcaaaccgcactgttctaattttacgctggataccgccgctcccggctggcgctggctggaactgcgcgccgacggcacgctgcatacggaagtgtgccgcctgcaaagcacgcagtttcgtccggataccgcttcagaaggttactgatgtctacgcttctttatttgcatggctttaacagttcgccgcgttcggcgaaggccacccagatgcaacagtggcttgccgggcatcatccgcacatcaatatggtggtgccgcaactgccgccctatcctggcgaggccgctgaactgctggaatcgctggtgctcagacacggcggcgagccgctcggtatcgtcggctcgtctttaggcggctattacgccacctggctgtcacaatgttttatgctgcctgccgtcgtggtgaacccggcggtgcggccctttgaattactgcgggattttctggggcagaacgagaacccctacaccggtcagcaatatgtgctagagtctcgccatatttacgatctaaaagtcatgcagattgacccgctggaagcgtcggatttactctggctgctacagcaaacgggcgatgaagttctggattaccgccaggccgtcgcgtattacgcgtcatgccgccagacagttatcgaaggcggaaaccatgcctttgtgggctttgacgatcatttcacacagattatcgatttcctcggactgcattaagtctgtcgggaaacgatgcgatcactatctacgaacaaaccatgacgcaatcctataacgctgatgccattgaggtactgaccgggcttgagccggttcgccgccgtccggggatgtataccgacaccacccgcccaaaccatctgggccaggaagttattgataacagcgtggatgaggcgctggcaggtcacgcgaagcgcgtggatgtcattctgcatgccgatcagtcgctggaagttatcgatgatggccgcggcatgccggtggatattcacccggaagagggcgttccggcggtggagttgatcctctgccgtctgcacgcgggcggtaaattctccaacaaaaactatcagttctccggcggcctgcacggcgtggggatctccgtcgttaacgccctgtcccgacgcgtggaagtgaacgtgcgtcgcgatggcaaaatctacaacatcgcttttgaaaacggcgagaaggttaaagagctggacgtgatcggcacctgcgcgaaacgcaacaccggtaccagcgtccatttctggccggatgaaagcttcttcgacagcccgcgtttctctgtctcccgtctgacgcacgtgctgaaagccaaggcagtgctctgccctggcgtggaaatcacctttaaagatgaagtgaacggcagcgaacagcgctggtgttatgccgacgggctgaacgactatctgggcgaggcggtaaacggcctgcccacgctaccggaaaaaccctttgtcggcagctttgccggtgacgtagaagcggtggactgggcgctgctgtggctgccggaaggcggtgagctgctgacggaaagctacgtcaacctgatccctaccatgcaaggcggtacgcacgttaacggtctgcgtcaggggctgctggacgcgatgcgtgaattctgcgaataccgcaatattctgccgcgcggcgtgaagctgtcggcggaagatatctgggatcgctgcgcttacgtcctgtcggtcaagatgcaggatccgcagttcgccgggcagaccaaagagcgcctctcttcacgtcagtgcgcggccttcgtgtccggcgtggtaaaagatgcctttacgctctggctgaaccagaacgtccagtcagccgaaatgctggcggaaatggcgatttccagcgcccagcgccgtatgcgcgccgccaagaaagtggtgcgtaaaaagctgaccagcggccccgcactgcccggcaagctggcggactgtaccgcgcaagatctgaaccgtaccgaactcttcctcgtggaaggggactcggcgggcggctcggcgaaacaggcgcgcgatcgtgaatatcaggcgatcatgccgcttaagggtaaaatccttaacacctgggaagtctcctccgatgaagtgctggcgtcccaggaagtgcacgacatttcggtggccatcggtatcgatccggacagcgaagatttaacccagctgcgctacggcaagatctgtatcctcgcggatgcggattccgatggcctgcacatcgctacgctgctgtgcgcgcttttcgtgaagcacttccgcacgctggtgaagcacggacacgtctatgtggcgctgccgccgctctaccgtatcgatctcggtaaagaggtgtactacgcgctgaccgaagaggaaaaagccggtgtgctggaacagctgaagcgcaagaagggaaaaccgaacgtccagcgctttaaaggcctcggcgaaatgaacccgatgcagctgcgcgaaaccacgcttgatcccaacacgcgccgtctggtgcagctgaccatcagcgatgaagacgatcagcgcacgacggcgatgatggatatgctgctggcgaaaaagcgttccgaagatcgccgtaactggttgcaggaaaaaggcgatctcgccgaacttgacggctaatcagcaaataacagcggggcgaattatcgccccgcttttttttatgctttcgccagcctgagctttatcatcagattgcgggtctcgttaataatattcttctttaagcgcaggaaaggaaaaacgaaccacagccacagcacatattttttatggtcctgcgaacttaacttcaccaccggcgttttcagtcgcgcatactgactcttctttatttgttttaacgccgttttatcgacgctggtataaacaaatccgcactcctgataattctcgatatgataaaaccccgcgcaggcgtttattctggcgatggcgattgaaaagggaacagggccggtggtacgcagcacgcccattcgcccgatgccatacacccagggtttgtaagaccttatgcgtgacaccacttcatcgatcacccctttgatccacggcgaacgcgcgcagaccgtgatgttccactgctgatactcaccgttttccagaaaagagagctccgcgtgacgacctgtctgtttccgccgcccgcaggccgtgctttgccagctgcacagcaatagctgacagtcgtcagggataacctcatccagcggtcgcgagcaggcgcttttgatatccagatagacaccgccttccacgtacagcatcagataacgaaaaaaatccgcccgtgccgcgccgtattcagggttgatcataagccaggtattcagcatctcttcgccatagtgctggcgaataaaatccttaatcatgctggtgtcataaaagtgataggtccagtgcggattattcttctttaatttttcaatagaagtaacgatgctctccggtaatgcataccaaccttttgtgtatatttgatgaattttttttggcaccttgttcataggcatccttcgaaacagaaaagtccggatcctgctatcaaaaagaaataagaaaacgtatcagcgcttattcagaccatcgtcctctgtgaggagttccgtctttcagctattcagaatgtatataaaagtaaaatataccgggaaggaataaacgataagaaaaagcttatttgccggacgctttctctgcggatttacctgaaggcgaatgatttttccggtactgcaacggggtttcaccgatacccttccggaaggcgctgataaagtaagtgacatcggaaaaaccgaccaccgccgccacctcgctgacgctcagcgggctgtgcaaaagcgcttcacaggctttgcgcaggcggatggtgttcaggtattgatgcagatgctcccccgtctccacatgaaagcggcgggagagatagctgcgcgatttccccagctcctgcgccagggtgtcgaggctgaatttctgccggtagttctcctccagccagaacatcacctgcgtcgccagactctggcggttatccgacggcgcggcgttatcgtccggcagcatagtgaacaacgtcagcagcaggcaggcgacctgctcagcattcagcggggcggtggcggcaaggcgggcatacagactgaacagattatcaatatgggcatgctgggcagaagcatccaccaccagcgccgggccgccgcgcgtcgacagcttttgcaggcgctgctggttttgcgggaaatcccgcaggatcttgagcactgcatgctgatcgacatgaatgatagtgcggcgataacagtcctgcgcctgctcgtcgaccatcaccttatgcagcgtgaagggcgggaaaataaacagccgccccggtcgcatggtgtactgccggttatcgacgatggcgatgccgtagccctcctcgacgtacagcacttccagacattgatgccagtgatggtaacgcaccgtattggcaaacaagcggctgaacgacactatggcatcgttaagggtaattaactccagacgatccgacggccacctttcggacatggtgcaataattctcaacttttaccggtcaaaaagcatttataaaccctttttttaaattttctcaacacccagttcaaaagagttctgcgggtgtgacaaaggtaacatttctggctgtcgcccattcactatgcttgtgccacttgattgtgagaggcagaaccatgctgacggcgactacagaaacctcaaatacattgtcttcccgcgcggaggtggttgatgcattaatgaccatgctcggcgcgctggatcggcagtttcccgcaggaagctcaggctttccattaggggatacctgcgcccattacggcgctgatattgccatgatggagggattgtcacgcgcgctgtggggcgtgtttccgctgatggcggggggcgaacccgtgccgtacagcgataaatatctcacggcgattaaacagggcaccgatccgcagagcgccggatactggggcgataccgggccttacgatcagcggctggtggagatggcggcctacgggctggggctttcgttattgcaggataaactgctggaaagcttcaccgcccgcgagcgggaaaacctgcatcgctggctgaaccagatcactgacgcgcaaatgccggacagcaactggaactatttcgccatcatggtgcagctgggattcaaacgcgccggcctgccctgggatcgcgccgccattgagcaccgctttgagctgatggaagcctattatctgggcgacggctggtactctgacggcccgggccgcccgaaagattattacatctcgatggcgttccacttttacggcctgatctacgccacgctcaacggcgaagacgatcccgcccgcgcgcagatcctgcgcgatcgtgccgcgcagtttgcgcaagattttatttatatgtcggcgaccggaggcgagtcggtgccctttggtcgcagcctgacctaccgtttcgcaatggtggcattctggagcggcgtggcgtttgccgggctggaggtgttctcgccgggcgtggtaaaaggcattattctgcgccatctgcgctggtggctgaaacagccgatttttgaccgcgacggcattctgaccctcggtttcgcgtatcccaacctcgctttctgcgaagactataactcaccgggatcgccgtactgggcgctgaaagtcttcctcatcctggcgctgcccgcggagcatccgttctggctggcggaagagcagccgctgcccgcgctggacaataaacgtgtcattccccatgcgcagcagatcctcgtgcacagcgagaattcacagcatgtgtacatgctcacctccgggcaactggagctgaacaattatgtgaataccgaagccaaatacaccaaattcgcctactccagccgctttggtttcaccattgagcgcgggcgctacggcattaagcacgccgcctgcgactccatgctgctgctctcggaaggggataactactggcgtggccgccgcgagtgcgacgaggtggtggtgcgagacgatcatattttttcgcgctggtcaccctggcataacgtgcagatcgccagctggcttatcccctgcggcgactggcatgtgcgcattcaccacatcaacaccgcccgccatttaaacagtaccgaagggggcttcgcggtgatgaaggcggatccacaactgctggctgacggctgcttgttacaggcccgtaatggcaccagcgccatcctgtctttacccgccggggcgtcacgccaggcggactgcattattacgccgccgaacagcagcgtgatgttcgccgaatgtgccgctataccggtgctgacgggcgagctggcaccgggtgaatactggctgtgttgcgcggttcgcgcaggcgcgcatcaggaggcatttacccgcgccgttccggacgtacagcgtgatgccagcgcccttgtggtgcgtcatccgctatcgggaaacccaattaccatcaaagtataaataccgggcgtcagcccggaataacactcaacctctgtatctgcatgctttcgtcgaggatagtatggctaaaatattaaccaccaaccggtctgaatattacaagatcagtagttttatctttctttatttctttacctggtcggccagtattggtctgctggccatctggcttggacaaaaagcgaatttaagcggcaccgttattggtactgtgttcgcggtaaacggcatattttcggtgatcttaaaaccgatttacggctacattctcgataaaatcggcatgagtaaatatttgctctattttgtcgtggcgatgtcggcattaatggcgccgttctttatttatgtttatcagccgctgttaatgtccaataccatgctgggcattattgtcggggcaatctatttaagctttgcctggtatgccggcgtggcggcctgcgagtcctataccgatcgctacagccgcctgaacggtatggagttcggccagatccgcatgtggggatcgctgggctgggcggtggcgtcatccttctccggcctgctgtttaacctctcgcccgcgtataactttatgctcggcagcgtggcttccatcgtgatgctggtggtgctgttcagcctgaaagtggatacccgcacggcacacgccagtgaagtgctgaccaaagaaaaaatcgccccggctgacgtctatgcactgctgaaaagccgcaaattctgggccttctgcctgtacgtggcgggcgtggcctggatgatgtttatcgccgagcagcagttctcccgctatttcgtcaccttctttgatgatgtgcatcagggcaacgccatcttcggttatctcggtaccgttcagtccggcatggaattcatcatgtatatggtgatcccgctgtttgtgaattacgttggtgcgaagaaaggattattaatcgtcggattactggtaggcgcgcggctgattatttccggcgtttgcgattcccatctgcttatttccgtactcaaaccgctgtatggtctggaaatctgtctgctgctggtgtcggtatttaaatatatcgccgagcatttcgataaacgcgttaacgccactatgtatctgctgggttatcaggcgatgctgtatgtcggaaatgtggtggtgtcgtctccggccgggctgatgtacgaccgtatcggcttcgagcagacctatatcatcatgggttccattgccctgttctttacccttgtgtctgctttcacgctgtccgcctgccagagcaaaatgcgcccgaacgcgccgctggacgtggccggaaataacgcctcacgctaatccctgaagcgggatgatgttatcccgcggtagtcagtcaaaaggaaccgaaatatgttaaataatatcgttgaagaaccgttacgtgcattcccggaggcgctggatcgccaggcgtttagcgacgagatggattccgcccgtaaccatgttctgacgctgatccgccgtcatttaaccgagttcggtgataaatttcccgcagaagcggcggtggacgggcgctatccgctgacggaaaacgttgaatggaccaccagtttctggaccgggcagctgtggctggcatgggaaatgagcggcgacgcggttttccgtgagctggcggaaaagcacgtccgctcgttcggcgcgcgtattgccggtcgccaagataccaatacccacgatctcggctttctttacacgctctcctgcgtggcggcatggcggctgacgggtaaccgcgatgcgcgcggtttctcgctgctggcggcggaggcgctgctggagcgttttcacgtccgggcgaaaattattcaggcgtggggcgatctgaaagatccggcacaggccgggcgcatgatcatcgactgcaccatgaacctgccgctgctctactgggcgacggagcagaccggcgatccgcgctttgccgacgccgcgaaagcgcacgttcagcagtcggcgacttacctgatccgcccggatgcctccacctaccacacctactatatggatgtggaaaccggcgcgccgcgctacggcaacacccagcagggctatgccgatgattcgtgctggtcgcgcggtcaggcgtggggaatttacggtttcctgctcagctatatctataccggcgatcgcgagatgatcgcgctttccaaacggctggcgaactatttcctcaaccgtctgccggaagattatgtctgccactgggatctggcgctgcttggcaccgatgcgctgcgggattcgtcgtctgcggccattgccgtgtgcggattgctggaactggtgaagcacctgccggtgaccgatccggatcgcgcacgctatcagcagtgggcggaagggatcatgtcctcgctgacgaagcattatctggcgggcaacgacgaggcgtgcaacggtctgctgaaacactccgtctatcatcttgccagcaataaaggcgttgatgagtgcagcagctggggagattatttctacgtggaagcgttgatgcgcgtgacgcaaagctggaagctgtactggtgatttgtcttataccctctcccgacgggagagggtaatggggcattacacgccctgctcaagaatacgaatatgggtttccagcacgtcgcctttcaccgcctcgctccacgccttcatgtgcggagtttgcagatgcgcttcaaggtgtgcgacggtttcccacagttccaccatcataatggaatccgggttggtgctctggaagctcacgccggcagcgtgatccaccatcggcgcatagccgtggcagccttcttctttcagtacggtcgggataatcttcgcgaattcgtcgagcaccgcctggcgatggtgttggcccgggcgggtacgaatctcagcaatcactgttaacatggtttaactccttctaaattccatctcacagttaagcaaaaatttccgcaagatgcttgcgatattctgcaatatagcgcggcacgtccggcattttgatcacgtcgttggtgataaaggtcggcagcggatcgaggcccaggaactgattcgctttgtggaacggcaggtaaacgccgtcaacgccaacgccatggaagaactgctctttatcggtgaaagcttccagcggcgcgttccaggtcagcgacagcatataagttttaccctgcaacagaccgccggaaccgtatttcttcgcgccgtcagagcgggtacggccatcgctggcgtacagggaaccgtggccttcagtgaacacatcgtccatatattttttcaccgtccagggcgcgcccatccaccagcctggcatctgccagatgatggtgtcggcccacaggaagttctgcacttcggctttgatgtcgtaatcgctgtcggcacgcacgacgcggacatcatgtccggcgtcacgcagaaaaccctgcgcgacctcggtcagggtgtcattcagctggcctttggagtgggcgaactctttcgcgccgttaacaatcagaatgttgctcattatttatcctcgaataattgcgtttgacgacaatcttacccgcaacgacgggacggtaaaatgagcaaaatgtgcaaagtcttttgctgctggcgcaataatctttaccagctgatgtcgacggcgaaaccagttggcgtcatctgccggaagtgcactgtcatctgatgtagcgccgcgatgcgccgaacaatggacaaccccagcccgctgccggtttcttcctgacctggcgggcgataaaaacgctcgccgatacgcgccagcgcctgcgcgctgacgccggggccgttatcccgtacgcaaaaaccgcgcgccttcagcaccacatccacccgggatcccggtggacagtagcggatggcattctccagcagattgcgcaccagcagttgcagcaacaattgatgcccgcaaaaggtgacgttgtcggcgcgcgtctccagccgcagatcgatgcccgcccgctgcgcgccagaccacgcttccataatggcgctttgcagcagatccgccatcgggatcggctccggctcctccagcccgttcagcgagtcaaggcgcgagagggtaagcaattgctccaccagccgtgacgcgcggtcgatcccctgacgcagattggtcagcgcatgatccagcgacgccggatcgtcctgtgaaagctgcgccacgtcggtctgcaccttcagcgccgccagcggactgcgtaattcgtgggcggcgtcagaggtaaagcggcgttcacgggacataaattcatgaatacgtgtgaacagctggttcagctcatccaccatcgggcgcacttcctgcggcgtgccgtccaccggcagcggggttgtggcgtccggcttacgctgatgcagcaaccgggcgatgcgccgcagcggcgacagctcgcggctgaccagccacaccagaaacagcagcatcaccggtagcgccaccagccagggcgtcagctgcgacatgacgatttccagcgccagatcctcgcggtactctttttcctgcccgacggcgatgcgtcgttcgccgtcttcggtggtcagccacagcacgcgccagtcgtcgccatccacacgcgtatcctgaaaaccgtcctgccggtagtcgtaatccagttcggtaccgttatcgccgtcgttcagcagtcgcttgccgtcgcgggagaaaatagcaaacgccagcacatcgtcatcgagtctgccgtgatgatggcgcaccagctttttactttccggcagcgtctgcgccgggcgcatatcggcgggatcaagcacgctcaggcgttttgccagcagcatttgctgggtatcaaacagcttatccagcgaatgccgcgtttcatgccatgctgccaggcaggcgcagccccaggcaacgatcgccagcaccataaatccggtggtaagccttaagcgcaggctgtgggtcagggtcttaatcatgcgtctcccagtgaatagccaatgccatgcacggtgcggataaaacggctgcccagcttgcggcgcagatggtgaatatgcacatccagcgcaccgcgggagacgtcatcgtcccagttataaagtttttcttcgataagcgagcggggcagaacgcgccccggattgcgcataaacagcgccagcagggcgaactctttcggctgcaacaccagcggttcgcccgccagcgtggcggtgagcttaagcggatcgagcgtcacctcgccgtgggataacgtggcctccacgccgccatgatgccggcgggttaaggcttcaagacgggcggcaacttcaatgagcgcaaagggtttgcagagatagtcgtctgcccccagccgcaacccttccacccgctgctccagcgcatcccgggcggtaaggatcagcaccggatgctgatgtccggcgcgtcgccacgctttaaggatgtcgagtccgtccatgcccggcaggctgagatcgagcaccacggcgtcgtagggcgcctgatccagcgcctgcataccctgcctgccatcggtaaaccagtcgggcgtcatccccagtttgctcagacccgctttcagcccgtccccgatcagcctgtcatcctcaatcagcaatatgcgcataccgtctcctccatggttcctgctggcagttaatacccgctggctgcgggcttgtacagggaaaatcgccggtaagttaacccttccggcattatcgacagaaaaagcagaaaaaatgttggctgttaagaacccgctaagatctgcggtgttaactgatgcttaaggttacccatctacaaggagaagacgtgatgaaaaagaccgcagcactgttaactgtcctgatgtttgcttctgctcccgcactggcgatgcacaccggcctgacggagcatgaaacgggtgaagcgcgccatacggggcagggaaataccgccaccgggaatatcggccatgacggtcatggtcactggggcgataacaccacggcgccgaaaccacagccgaatgcttcaacccggacgcagccacaaagtaacaacagttaatttttcagccaggcctgggtttgcaggcctgttatagttatttactgttagccatcctcaagggagaatcatcatgaaaaacatcgctatgctttttaccgtgctggccctggcctctgctccggcgcttgccgccacccagggcggttttcaggcctctgataccgcaacccaaacgcaaaacggcggcggctttactggcccgtcgggcaccaaaaccacggccgaaaaagcgaaatccctgtccgatgacgcctgggttacgctgacgggtaaaattgaacagcgtaccggcggcgacaactatttgttccgtgatgaatcaggcaccatcgatgtggaaattgatgataaacgctggaatggccagaccgtcaccccgcaggataccgttgaaattcaggggaaagtcgataaagactggaactccgctgaaatcgaggtgaagaaaatcaccaaaaccagtaagtaactggcatcgggccgggaaaccggcctgcttttcatccctcatcatcgcctttcgatctcccccgacaaaaaccgcccggtgcgctaaagttatcgcgcagcacaatgactcattgccttatataaggtagtatctgcggcattatcgccgccggaaaggcgggcgcacacgttgaggaacatcgattaatgagcgatatggcagagcgccttgcgctgcatgaattcacggaaaacgcctacttaaactattccatgtacgtcatcatggatcgggcgctgccgtttattggtgatggcctgaaacctgttcagcgccgcatcgtgtatgcgatgtcagagctcggtcttaacaacagcgccaagttcaaaaaatcggcccgtaccgtaggtgacgtgctgggtaaatatcacccgcacggcgacagcgcctgctacgaagccatggtgctgatggcgcagccgttctcttaccgctatccgctggtagacggtcagggcaactggggcgcgccggacgatccgaaatccttcgccgccatgcgttataccgaatcccgtctctctaaatacgccgagctgctgctgggcgagctggggcagggcacggtggaatggcagccgaacttcgacggcaccctgcaggagccgaaaatgctgcctgctcgtctgccgaatattctgctgaacggcaccaccggcatcgcggtcggcatggcgacggacatcccgcctcataacctgcgtgaagtggcgaaagcggcgatcgcgcttatcgaacagccgaaaaccacgctggatgagctgctggatattgtgcaggggccggattatccgaccgaagcggaaatcatcacctcgcgggcggaaatccgcaaaatctaccagaacgggcgcggctcggtacgtatgcgcgcggtctggaccaaagaagacggcgccgtggtgatcaccgcgctgccgcaccaggtctccggcgcgcgcgtgctggagcagatcgccgcccagatgcgcaataaaaagctgccgatggtcgacgacctgcgcgatgaatccgatcacgaaaacccgacgcgtctggtggttgtgccgcgttcgaaccgcgtggatatggatcaggtgatgaaccacctgttcgccaccaccgatctggaaaaaagttaccgcatcaacctgaacatgatcgggctggatggccgtccgtcggtgaaaaacctgttggagatcctctccgagtggctggtcttccgccgcgacaccgtgcgtcgtcgtctgaatcaccgtctggagaaagtgctcaagcgcctgcatatcctcgaaggtttgctggtggcgttcctcaacattgatgaagtgattgagatcatccgtactgaggacgaaccgaagccagcgctgatgtcgaagtttggtatcagcgaaacccaggccgaggcgatcctggagctgaaattacgccacctcgcgaagctcgaagaagtgaaaatccgcggcgaacaggccgagcttgagaaagagcgcgaccagctgcagggcattctcgcctccgagcgcaaaatgagtaacctgctgaagaaagaactgcaggcggatgccgaagcttttggcgacgatcgccgctcgccgctgcatgaacgcgaagaagcgaaagcgatgagcgagcacgacatgctgccgtctgagccggtgaccattgtgctgtcgcagtctggctgggtgcgcagcgccaaagggcacgacattgacgcgcagggcctgagctacaaagcgggcgatggctggaaagcctcggtgaaaggcaagagcaaccagccggtggtgtttattgataccaccggacgcagctacgccatcgatccgatcacgctaccttccgcgcgcgggcagggcgagccgctgaccggtaagctgacgctgccgccgggcgcgtctgtggaacatatggtgatggcaggcgaagagcagaaactgctgatggcgtcggacgcaggctacggcttcgtctgcacctttaacgatctcatcgcccgtaaccgcgccggtaaagcgctgatcacgctgccggaaaatgcccgcgtcatgccgccgctggaaattaccgacgacagcgatatgctgctggcaatcaccgccgccggacgcatgctgatgttcccggtcagcgatctgccgcagttgtcaaaaggcaaaggtaataagatcatcagcattccgtcggccgaggccgctaaaggcgaagacagcctcgcgcacctctatctgctgccgccgcaaagtacgctgaccatccacgttggcaagcgcaaaatcaaactgcgcccggaagagttgcagaaggtgcatggcgagcgcggacgtcgcggcacgctgatgcgcggcctgcaacgcatcgaccgcgtggagattgactccccgcatcgcgcaagccccggcgacagcgaagagtaatcacggtatcaccgtcccccttttcttacgggggacgtcagttaaaatttcccgaatggccggatgccccgggcataagaggtagctatgctgtttattattcgctctattattattgttgtttacagcattttgctgtgtatttttggttgtatttactgtctgttcagcccacgtaatccgaagcacgtcgccacttttggtcatatgtttggccgcctggcgcctgtgcttggcctgaaggtggaaacccgcctgccgccgaatgccgctgagtttggcaacgctatctatatctgtaaccatcaaaataattacgatatggtcaccgcgtcctgcatcgtgcagccgccgaccgtgaccgtgggtaaaaaaagccttatctggatccctttcttcggcctgctttactggctgaccggcaacctgttgatcgaccgcaataaccgcgccaaagcgcacggtactatcgcccaggtcgtgaagaacattcagaagcgtaatatttcaatctggatgttcccggaaggcacccgcagccgtggccgtggtctgctgccgtttaagaccggtgcattccatgcggctattgccgccggtgtgccggtgatcccggtatgcgtctccaccacctcgaataacatcagcctcaaccgctggaataacggtcatgtgatcgtcgagatgatgcaaccggtggataccaccaagtttggtaaagatcaggttcgtgagctggcagtacactgccgggcattaatggaaaataaaatcgccgcgcttgaccaggaagttgccgtgcgcaatgccgccgataagcgttaattttccctcgtattaaaagtcagttttacatggagcagatatgtcactcagtcggcgtcagtttattcaggcatccggggttgcgctttgtgccggagcggtgccgctgagggcaaacgctgccgggcagcaactgccgttgcccattccccccttgctggaatcacgccgcggccagccgctgtttctgacgcttcagcgcacgcactggtcctttacccagggcacccgcgcccaggtgtgggggattaacggccgctatctggggccgacgatccgcgtctggagcggtgacgacgtgaagctgatctacagcaaccgcatgacggaaaacgtcgccatgacggtaagcggcttacaggtgcccggcccgctgatgggcggcccggcgcgcatgatgtcacctaacgccgactgggcgccggtgctgccggtgcgccagaatgccgccacgctgtggtatcacgccaacacccccaaccgcaccgccgaacaggtctataacggcctggcgggaatgtggctggtggaggatgagatcagcaaatccctgccgatcccgaatcattatggggtggacgacatcccggtgattattcaggacaagcggctggataactttggcacgccggaatacagcgagccgggcagcggcggctttgtgggcgataccctgctggcgaacggcgtgcaggggccgtatgtcgaggtttcccgcggctgggtgcgtctgcgtctgctgaacgcgtctaacgcgcgccgttatcagttacagctgagcgacggtcgcccgctgcacgttatttccggcgaccagggctttctgcctgcgccggtgtcggtgaagcagctgtcgctggcgccgggcgagcgccgggagatcctcgtggatatgaccaatggcgatgaagtgtcgataacctgcggagaagcggcgagcattgtcgatcgtattcgcggcttcttcgagccatcgagcatactgatctccaccctggtgctgacgctgcgtccgaccgggctgttgccgctggtgaccgacagcctgccgatgcgtctgctgccgagcgaactgctgaccggcacgccggtgcgcagccgtgatatcagcctcggcgacgatccgggtatcaacggccagctgtgggacattcagcggctggatattaccgcccagcagggcacctgggagcgctggacggtgcgcgccgacacgccgcaggcgttccatattgaaggtgtcagcttccagatccgcaacgtcaacggcgccattcccttcccggaagatcgcggcatgaaagataccgtgtgggtggatggtcaggtagagctgctggtgtacttcgggcagccgtcctggccgcatttcccgttccagtattacagccagacgctggagatggcggatcgcggatctatcgggcagttgctggtgaatcccgccccctgatttttttcccctcaccctaacgaacggcccggtattctccctctcccctggggagagggccggggtgaggggttaaacaagggtgatttttaaacaataagccttcattctctgcggtattacagcgtataatccccgcccttcgaatttgataacttttccccggaagcattatgagcgctatttccctgatccagccggatcgcgacctcttttcgtggccgcaatactgggcggcctgctttggccccgcaccttttttgccaatgtcacgggaggagatggaccagcttggctgggacagctgcgacatcattctggttaccggggatgcctatgtcgatcatccaagcttcggcatggcgatctgtggacgtatgctggaagcgcagggcttccgcgtggcgatcatcgcccagccggactggagcagcaaagaggatttcatgcgtctgggcaagccgaatctgttcttcggcgtcaccgcgggcaacatggactcaatgattaaccgctataccgccgaccgtaaactgcgccacgacgacgcctatacgccggataacgtggcgggtaaacgccccgaccgcgcgacgctcgtttatacccagcgctgtaaagaagcctggaaagacgtgccggtgatcctggggggtatcgaagccagcctgcgccgtaccgcgcactatgattactggtctgataccgtgcgccgctcagtgctggtggattcgaaagccgacatgctgatcttcggcaacggcgagcgcccgctggtggaagtggcgcatcgtctggcgcagggcgagccggttggcaatatccgcgacgtgcgtaacacggcgatcatggtgaaagaggcgctgccgggctggagcggcgtggattcccgcatcattgaccggccaggcaaaatcgatccgatcccgcatccctatggtgaagatctgccatgcgccgataaccaacctgttgaacccaaaaaagccgaggcaaaagctgtcgttgtgcagccgccgcgcccgaaaccctgggaaaaaacctacgtgctgctgccgtccttcgagaaggtaaaagccgataaagtgctctacgcccatgcgtcgcgcattctgcaccacgaaacaaacccaggctgcgcccgcgcgctgatgcaaaaacacggtgagcgttatatctggatcaacccgcccgccattccgctctctacggaagagatggacagcgtctttgcgctgccgtaccagcgtattccgcatccggcctacggcactgcccgtatcccggcctatgagatgatccgcttttccatcaacattatgcgcggctgctttggcggctgctcgttctgctccattaccgagcacgaagggcgcattattcagagccgctctgaagattcgatcgtgaacgagatcgaggcgatccgcgacacggtgccgggctttaccggcgtgatctccgatctcggcggcccgaccgccaacatgtatatgctgcgctgcaagtcaccgcgcgccgagcagacctgccgccgtctgtcgtgcgtctatcctgacatttgccagcatatggataccaatcatgagccgacgatcaatctctatcgccgcgcccgcgatctgaaaggtatcaagaagatcctgattgcctccggtgtgcgttatgacatcgccgtggaagatccgcgctacattaaagagctggcgacccatcacgttggcggttacctgaaaatcgccccggagcataccgaagaagggccgttgtcgaagatgatgaagccgggcatggggagctatgaccgctttaaagcgttgttcgacacctactcgaaacaggccggcaaagagcagtatctgatcccgtactttatctccgcgcaccccggcacacgcgatgaagatatggtgaacctggcgctgtggctgaagcagcgacgcttccgcctcgatcaggtacagaacttctatccgtcgccgctcgccaactccaccaccatgtattacaccggcaaaaacccgctgggtaaaattggctataagagtgaggatgtggtgatcccgaaaggggataagcagcgtcgtctgcataaagcgctgctgcgctatcacgacccgaaaaactggccgctgatccgtcaggcgctggaagagatggggaaaaaacatctgattggcggacgccgcgactgcctggtgccgtcgccgaccattgaagagatgcgcgaagcgaagcgccagaaccggcatactcgcccggcattgaccaaacatacgccggtggcgcatcagcgtcagacgccggtcagcgccagaaaacgcagtaaggttgccggggggtaagcctgttgcccggtggcgcttcgcttaccgggcctacaggccgttgcccggtggcgctccgcttaccgggcctacaggctgtaggccggataagacgcgtgcgtcgccatccggcaatgaattacccgccgaactgatccgggtccgggccaagacgtttgccctgatccagtttggcgatttcactcagttcatctttatccagacggaaatcccacacatcgaagttttccgcaatgcgcgcaggcgtaacggatttcgggatcaccaccagaccctgatccagatgccagcggatgacgatttgcgccggagtcttgctgtatttgtctgccagcgagcggatcactttctgatcgaacacgccttcgccgccctgcgccagcggactccaggattcagtctggatcttatgggtggcgttccaggcatgcagctgacgctgttgcagcagcggatgcagctcgatctggttgatcaccggcgtcacgcccgtttcatcaatcagacgctgtaaatgcgcgatctggaagttacacacgccgatgcttttcaccagcccttgttcctgcagggcgatcatccctttccaggcttccacatagtgatcgatagccggtaccggccagtgcatcaggtagagatcaacatgatccagctgcagtttatccagactttcctgcaatgcttcctgcgggcgtttttgatcgtcattccacagtttcgtggtgatgaacagctcctcacgcgggatgccagcgctctgaagcgccttgccgacgccttcttcgttcttatacgcggcagcggtatcaatggagcgataacccacttccagcgctttatgaatggcggagatcacttcctcattgcccgctttccacacgccgagacccagttgcggcatgatgttgccgtcctgaagcttgataacggttggatttgccatgcattcctccttttatgaaatccaccaggcatacgcctggtgaagtggtgtgccttaagtctggacgaaaagcccaaaaacgaaaggcgcagaagaaaaaacctttagcgagccgcttcgtagatacgacggctgacatccagagttatatcctgatgttcgcctaaattcgtcataccgtgctcttccagtttcgccagcagggcagggatggagctgccgtccagaccgtagccggacaggcgcgtcggcacgcccatttgctcgaagaaatcgcgggtggccgcgatagccgcatcgatacgctcgtcgtcagaaccttcagtgatgttccacacgcgctcggcgtactgcaacagcttgccgcgtttggcgtcgcgtttctcattccacagcgcaggcagcaccaccgccagcgtctgggcgtgatccagaccgtgcatcgccgtcagttcgtggccgagcatatgcgtcgcccagtcctgcggcacgcccgctccaatcaggccgttcagcgcctgggtcgctgcccacatcacgtttgcgcgtacgttatagttctccggatcggtcagcgctttcgggccgtcttcaatcagggtcagcagaatgccttctgcaaaacgatcctgaattttggcatccaccgggtaagtgacgtactgctcaacggtgtgcacaaaggcgtccaccacgccgttcgccacctggcgcggcggcagggtgtaggtgtaaaccggatccagtaccgcgaagaccggctgcacgaacggcgaatggaacgcctgtttatcaccggtggctttacgggagatcaccgcgcctttgttggactcagaaccggtggcgggcagcgtcagcacggaccccatcgggatggcgcttttgatttcgctgccagaggtttgcaggatctgccacggatcgatgccttccgggtagtgggccgccgcggcgataaatttggtgccgtccagcaccgagccgccgccgaccgccagcaggaaggtcacgttttccttacgcgcaatctcaacggctttcatcagggtttcataagacgggttcggctcgatgccgccaaactccagcacgtcgaggccattgagggcgctgtaaacctgatccagtacgccggtttttttgacgctgccgccgccgtaagtgatcagcacgcgtgcgcctgccgggatttgatcgcgcagatcggcaatggcgtttttaccaaacagaatgcgggtgggggtatgcagattaaagttattcattgctcgtgcccttatgtgggttaaaaaaccgctgaccatggatggcctgatgcgtctcattgtggtcatcggggctgttcctctcaatgcacattcctgccgatgtcttgcccatttctccatgccgctggagaatatgcacagaaatacgcacactgtattcgtcaaaaaacccatccggagtggcgtgaaatgaaccgcgaagaaatatgtctgcacctgacagaacaggttaagcgactgaaaattcatgagaacaggctgagcgacctgttgccggatatccgcctgctgtacggcacacagccgggcacgcgcacgccggtgatgtaccagccgggcatagtgatcctcttttccgggcataaaacgggctatatcaacgaccgtgtatttcactatgacgccaatgaatatttgctgctcaccgtgccgctgccgttcgagtgtgaaaccttcgccaccccggaagtgccgctggcggggatccgcgtcaatgtggatattcttcagcttcaggaactgctgatggatatcggcgaggacgagcatttccggccagcgctggcggcaagcggcattaactccgccacgctgtccgatgaaattctctgcgcggtggagcgcctgcttgacgtgatggagcgcccgctggatgcgcgtatcctcggcaggcaaatcgtgcgggaaattctctatcatgtgctgaccggcccgcgcggcggcgcgctgctggcgctggtaagccgtcagacgcacttcagcctgatcagccgcgtattaaaacgcatcgaaagccagtacacggaaaacctgagcgttgaccagctggcggccgaagccaacatgagcgtctcggcgttccatcacaattttaaagccgtcaccagcacctcgccgttgcagtatctgaaaagctaccgtctgcaccgggcgcgcatgttaatgattcacgacggtatgaaagccagcgcggcggccatgcgggtgggatatgaaagcgcctcgcagttcagccgcgagtttaaacgctattttggcgtgacgccgggagaggatgcggccaggatcaggatgatgcaggggacgtaacaaccccctcaccgcgaggtgaggggataaaagtcaggcgttgcagtatttctttttgatcaccacgatcactgtgcccagtaacccggcgaccagcaggaatacgggcaggatcatcaggaaggtcatcacctgatcttcatggcgcttcacgaaagggatcatgctcagcgcatagcccagcgaagtcaccgcgcccacccacagcagcgcgctcagccagttaaagaactgaaagcggcggttggagaggccggagatacccgccatcgttggcagcagcgtacgcacgaaggccagaaaacgcccggccagcagcgccagcaggccatgccgctcgaacatgcaggtggcccgctggtggtatttagccggcaactgcgccagccagcttttcaccacccgcgtattgcccagccagcggccctgaatatagctcagccagcagcccagactggcggcggtggtgaggatcaccagcgccggtataaagtccatcacgccgcgggcgatcagcgctccggttaagagaagcagactgtcgcctggcaggaaagaggccggaagtaatccgttttccagaaacagcgtcgcaaacatcacgaagtaaacgacaccgacaacatgtggatcagctaacgccgcgaaatcatgatgccagagcgcggcgataatatcttgaataactaccatggactttcctgtggaaccgcatatagagcgctattgtacgcctgaactgtcaaggacaccttgatcccccacgcaagaaatgcagacgattctgctggtctggaaagatttcttgtcaggctgctaactttacacgatgcgctcaaatcccgctgctaaatcagcacgtaaatcatcaacgttttctaaacctatatgcagacggataagtgtgccagtaaagtcgacctcggcgcccggacggatcgccgcaatatgctccggctggttcgccaggatcagcgattcatagccgccccaggagtaggccatgctgaacagcgtgaagtgatcgagataagccgccagctcctgattattcagccttttacgcagcacaaatgagaacaggccgctgctgccggtaaaatcgcgcttccagaattcatgtcctttactgcccggcagcgcagggtgattcacgcaagccacctgcggatgcgccgccagccattcggcgagttgcaggctgctttcatgatgctggcgcagacgcacgctcagggtgcgcaggccgcggctggtcatataggcggtgtcagcgtccaccatttgccccatcaggtaggcgttctcgcgcagttgctcccagcagcgggcattcgccaccgccgtgccgatcatgccgtcggagtggccaatcaggtatttggtggccgcctgaatggaaatatcaatgccgaaatccagcgctttaaacaggatgcccgccgcccaggtgttgtcgatcatgatgatcgcctccggggccacgcgccgcaccgcagcaacaatcgccggcacgtcgtgcacttccatggtgatcgagccgggggattcaaggaaaacgatgcgggtattgggttggatgagtccggcaatgtcgccgccgatcagcgggtcgaaccacccggtggtaacgcccattttcgccaggatttttgtgcagaaatcctgcgtaggttcgtaggcggtgtgggtcaccagaatatgatcgccctgttcaacaaacgccagaatggtattcgccacggcagccgcgccgcaggggaagagcgcgcagcccgcgccgccttccagttcgcacatcgcttcctgtaaggagaaatgcgtcagggtgccgcgacggccataaaacagctcgccgctggcgcgccctcgcgtggcctgcttttttgcttccaccgtgtcgaacaccagagaagaggcgcgctggataacgctgttcaccgcaccctgagtatattttttgctgcgcccggcattcaccagcgcggtatcaatgtgcttcgctgccataatcgaaacctgtttttatacgtctggatgtccagactaccatgaatgcccgattctgcatcctgagggttattcattcagcacaatattttctgaaaatggcccgatgaaaggttttactgagtaagcgcaatgaaaatgcacaggaataggggcatcatgtaaatactaatgagaactactatcaattcgacgctgttttgatattattatgctcagaatttgtgatttatgtccggagatacacagtgggtaataatttgatgcagacggatctctccgtctggggtatgtatcatcatgccgatattgttgtaaaaatcgtgatgattggcctgatcctggcgtcagtagtcacctgggcaattttcttcagcaaaagcgttgagctgatctcgcaaaagcgccgccttaagcgcgaacagcaactgctcggcgaagcccgttcgctggatcaggcgagtgaaatcgccgcctcctttaagtctaaaagcctcagtacgctgttaattaacgaagcgcagaacgagcttgagctctctgccggttcggaagataacgaaggcattaaagagcgtaccggtttccgccttgagcgccgcgtggcggctgtgggccgtcatatgggccgtgggaatggctatctggcgaccattggcgcgatctcgccctttatcggcctgttcggtaccgtatggggcatcatgaacagctttatcggtatcgcccagacgcagaccactaacctggcggttgtcgcgcctggtatcgcggaagcgctgttagccacggccattggtctggttgccgccattccggcggtggtgatctacaacattttcgcccgcatgatcggcagctataaagcctcgcttggcgatgtcgccgcgcaggtgctgttactgcaaagccgcgatcttgatcttgccgccagcccgacggctaaaccggtgcacgctgcacagaaattacgtttaggttaatgtcctatggcaatgcgtcttaatgaaaatctggacgataacggcgaaatgcatgaaatcaacgtgacgccctttatcgacgtcatgctggtactgctgattatctttatggtggccgcgccgctggcgacggtggacgtgaaggtcaatctgcctgcctcgtccagccagccgcaaccgcgtccggaaaaaccggtctatctgtcggtaaaagcggataaatcgatgtttatcggcaacgatcaggtgacggaagaaaccatgatcaacgcgctgaacgccgtgaccgcgggtaaaaaagacaccacggttttcttccgcgcggataaaaccgtggattatgaaaccatgatgaaagtgatggatacgctgcatcaggcgggttatctgaagataggtctggtgggtgaagaggtcgcgaaagcgcagtaatcgccttatcacgcccggcggcgctgcgcttgccgggcctactggatctggtaggccgggtaaggcgaagccgccacccggcaaatcaaagtgtaggccgggtgaggcgaagccgcccagagtgtaggccgggtaagcgaagcgccacccggcaaaagaacgctgactccggtcagcttttttttgcgcgttattccgcaaccggcggcgttttctctgtcagcgcgacgctggtgacgtttgacgtcagatagccgccatcagccagcttgcgggtaatacgcagcgtagccgtctcacgcgccagcagatgctggtagttggcttcgaggcgggacatgattttttcgtacagttcggggtggcgcttcgccacttcgttgatcgcggcgccgtaaatctcttctttgatctgtaacgcgtaaatttcgcggcggttctgccattttaagcgcaccagcgcggcaggaatggagatcagatcccgcgccagacgggtaatatgatcatttttactctgtaccagggcatcgagattttgctttaagataaattcgtcgcttttatgattatctaaagctaaataaacgttattatcttcaacatctttcacgttattcatcctctagtttataaaacaaaggcgcatctttttcgcgggtaatgaggttaagccagacatcattaccggcggcatttatctcttcggttttttcggcaattatttgacttaaggtttgggcatcaatgtccccttcggcttgtaaatcgttaagcagacgggtaaatgtttcaatttttactacgcggtataatcgatcttttatatggcggtcgcgttcttccagcagcatatttctcgattgcctggtatggctgacattcgttaatatatcgctttcgaaatcagagagcgttctttttccctgagtgaaattaacgtctttttctgcttcccccgattcagtttccttcgcggaaatgtgaaaacgagccgggacaaggttctcgggcagcatctctaatatcctttgatttcaaacgagtggggaaggggtccgggcgtgaggttcgttgacaatatcatggcagacttttaaaatcaaaaaaaatggagccagcccatgaacagtattttttattctgttattgctttgttgttacttactgcgggcgtactttttatgatgcgcgagctgaataaaggcacgccagccgcagacagcaacccacttcccgaggccgcgccgttgtcaaaggaggagggagaagatcacttttcaatgttaatgaatgccattacgccggtgtggtactggcgtgtcaatcatgaatatattgattttctgcacgcgacaattaaaagaatgaacatatcgcaaataaatagcgtgccgggcttatttgaagcgcaacgtcgttgcagcgatctgaattcagcagtgtataagtattacgataatataaaaaaacgctgccttaacggtgagaaagttccgcactccgatctggaattactgaacttaagtcagtgttttcacgaattcagtctcgacgcctatccggaactggtcacgctggtgtggccggagtatgcccgcccggacgtggatccgcgggatgtgcgcaccgcgcaaatttgatggctgaacatgccgggtgggtgtccccggcatggtgagattatttgtccgacgacgcctgccagagattcagctcgccatctgccacatgtttatcgatctgcgccagctcttccgcgctgaaggtcagattgtccagcgcccgcacgttttcttcaatttgctccggacggcttgcgccaatcagcaccgaggtaacgcgcgcatctttcagcaaccagcttaacgccatctgcgccatcgattgtccgcgctgttgcgccatctcgttgagcaggcgcaggctgttcaggttactgtcggtcagcatcttctcggttaatccgcgcacctttttcccttcccgctgcatacgcgagccgtcaggaatgccgttgaggtattttccggtcagcagaccctgcgccagcggcgtaaaggcgatacagcccacgccgttgcgctccagcgtatccagcaggccgcttttatccacccagcggttgagcaaattgtacgagggctggtggatgagcagcgggattttccattcacgcagcaaatcgaccatcgtctgtgtgcgttcagaggagtaggacgagatacccacatacagcgctttaccgctctgcaccgcctgcgccagcgccgaggctgtctcttccatcggcgtattttcatcaacgcggtgggaatagaaaatatcgatatactccagccccatgcggctgaggctctgatcgaggctggcgagcagatacttgcgcgagccgccggagccatacgggcctggccacatgtcatagcccgctttggtagagatgatcagctcatcgcggtaggccgcaaaatcctctctcagcagacgaccaaaattttcctcggcgctgcccggcggcggaccatagttgttggccagatcgaaatgggtgatgcccgcatcaaaggcggtgcgtagcagggcgcgctgggtatccagcggctgaacgtgaccaaaactgtgccacaaacccagcgacagagcaggcaggcgtaacccgcttttcccgcagtagcgatactgcatctgctcgtaacgggcaggattggctaaccagggcatgatgtctccttttttgattataaatattcgaaacgctgtttctattttagcgttaccgccgatcgccacaagccgcagcggtcacaaatctttatgattatgtagcgttgcttaactattcattaatgcgccttatggtttaagccctcaggcgtcacgcggcccggataccaggctggaaggcaggcgcggtgagcgcttgcgggtttggctcctcaaaaaaagcgcatctttattacgggtaacatatgcataatatggcgaaacacgtaattaactatacgtgccatatttaagattacttaatttaaattaatgcaccctttttaaattaccgtctatattgagatgctgcgactacagatagtaaatagtattatttaaataagggatttattcccccataaacattgtttaaaccaacccgagaatctattagttttgggaggattcttatttttcgcatcaataagaatgttagcaggctaaataaatggagtggggattttctctttaagataagtagcttacagatagtttccgctgtaactatctgctgaactttatgtaaaagtgtgagcaaaagtgaatggcgatattatttaaatgcctggagccttgttttttaaaggattcctggtggattattttttgatcaaaaaaggtccgccgtggcatacatattacgcatattttgccgataaccataataagtcccaccttctggatgggaatgcacctcaagcaaggaattaactatgtgtatgctccaaaacttcacaattcgctttgtgatgctcgccattcttggcgttttctgcctgctgtggtcaggtgtcggattatttagcgtgttatcgctgtcgaaagtggctgaaggtaatgatatggatcgccagctggtcacgcagatgacgctgctcagccagggcaacgatcagtatttccgcgtcgtcacccgattgtcacgggcaatggaggcaaaagcgacgggcggcagcgccgattttggtccggttcagcaggcgctggacaatatgaaaaccaaactggatgcgctgaaggcgatctcacccggcccgattgatgcgactgtttccgcacaggtgatcggtaactggcaggcgctgctggatcagggcgtgacggcgcaggttcagtttgcgcagcaaggcaatcttgacgcttaccgtaatcaggcaagcaatgtgacgcctgccctcagccgcgcctttggtgccagcaccgaagcgttcaacaaagcggcgaaccagatgctggatgatacccgcgtcatggtggatcatcagaccagtgttacccgcacggcgatcatcactgccgtgatatttggccttctgttactgctgttctccgatcgctatctggttgccatgctggttaaaccgctggcgaaaattcgccagcacttcagcctgatcgcccggggcgatctcagccagccggtagaggcgatgggccgtaactgtgtgggccagatggtgccgctgttgcaggaaatgcaggatagcctgcgcgatgcggtcagctccattcgttccggcagcgacaatatctggcgcggtgcaacggaaatttccagcggcaataacgatctctcatcccgtacggaagagcaggcggcagcgctggaagagacagcggccagcatggaacaactgaccgccaccgtgaagctgaacgcagacaacgcacgtcaggccagcgaactggcggaagtggcgtccaccactgccagcaaaggcggcgcgctggtcagcgaagtggtcaccaccatgagcgacatttcagacagctcgaagaaaatcgccgagatcaccacggtgatcaacagtatcgccttccagaccaatatcctggcgctgaacgccgccgttgaagcggcgcgtgccggtgaacagggccgtggtttcgcggtggtggcgggtgaagtgcgtaatctggccagccgcagcgcaggggcggccaaagagatcgaaaccctgattgcggactcggtcagccgcgtcgataaaggcgcaaaactggtgaacgataccggcaccaccatggaaggcattctgcgtgcggttactgaagtgaccactattatgaagcagatcgccggcgcgtccgcggagcagagcaaaggcatttcgcaggtcggggtggccatcacccagatggacagcgtcacccagcagaacgccgcgctggtggagcaggtttcggccgccgccgtggcgctggagcgtcagacggaggagatgcagcgtgcggttcagcagttccgtttatcggcagacgagcaaaagcttgccgccgcgcctgcggcgacatcgtcgtcacgccataccccgccagtaaaatcacccgtctctgacgagtgggtcgcgttttaacttttagtattctgatcaccaggccacgacggtaacgttgtggctttttttgtaaataaccatgtcacttttaaggttaattgtcgggccgatcgcagcaattttcccgggaaggggttgaaatagcgccacctttgcataaggaagcgcaattatggttacaaaaacatctgctattccgcccggcatcacgcgccgggatttcatgacgttatgcgctgccctggccgccaccatggggcttagcagccaggcggccgcccgcatggccggggcgctcagccagccgcagcgcctgccggttatctggatcggcgcgcaggaatgtaccggctgtaccgaatcgctgctgcgcgccacccatcccaccattgaaaatctgctgctggaaaccctttccctcgaatatcacgaagtgctgagcgcggcctttgggcatcaggccgaagacaacaaacatcaggcgctggaaaaatatcaggggcagtacgtgctggtggtggatggctcggtgccgctgaaggacaacggcatttactgcatggtcgccggtgagcccattgtcgaccatatccgtaaagccgctgaacatgcggcggccattatcgccattggctcctgtgccgcctggggcggcgtggcggcggcaggcgtcaatccaaccggcgccgtcggattgcaggcggcactgccaggcaaaacggtgatcaatattcccggctgcccgccgaatccgcataactttcttgccaccgtggcgcacatcattacctggggcaagccgcccgcgctggatgccaaaaaccgcccgacctttgcttatggtcgattgatccatgaacactgcgaacggcgaccgcacttcgacgccggacgcttcgcccgcgcctttggcgacgagggccatcgcgccggctggtgtttatatcatttaggctgcaaaggcccggaaacctggggcaactgttcgacgctgcaattctgcgatgtcggtggcgtgtggccggtggcgattggtcatccgtgctacggctgtaacgaagaaggcatcggcttttataaaggcattcaccagctcgccagcgtggaaaatccgacgccgcgcgccgacaaaccggaggtggcgcaaaaagagggcggtgcggtttccgccacggcgatggggttactcggcggcgtcattggcgtggtgggtggcgtcagcctgatgacggtgcgcgaactggggcgtcagcaaaagcacgatgacgccgatcgtcagggagagtgatcgtggacagacgtgatttcctcaaactctctgccgggagcgccttgctgtcaggcagcgcgtcttccgctttcgccgccgccagcaaccgtccgccgatccccggcgcgctggggatgctgtacgactccacgctttgcatcggctgccaggcctgcgtcacccgctgccaggatcttaactttccagcccgcaatccgcagggggaagccacctggtcgaacaatgacaaactttccccctacaccaacaacatcattcaggtgtggcgcagcggcagcgggcggcacaaagaccaggtgaaagatggttacgcctacatcaaaaagcagtgcatgcattgtgttgatcctaactgcgtgtcggtctgcccggtatcggcgctgaaaaaagatcctcttaccggcattgtgcattacgacgccagcgtctgtaccggctgccgctactgcatggtcggctgcccgtttaacgtgccgaaatatgattacgctaacccgttcggggcgctgcataagtgtgagctgtgtaatcagccggggctggcgcggcttgataacggcggtctgcccggctgcgtggaggcctgtccggcgggagcggtcattttcggcacccgcgacgcgctgctggcggaagcgaaaaagcggctggcgctgacgcccggcagccagtaccgctatccgcgccagacgctcagtacgggggatacttatctgcatccggtggcgcgttatgtgccgcatatctatggcgaaagggaggcgggcggcacccaggtgctggtgctgagcgccgtgccgatggaaaacctcgatctgccgccgctggatgagctctctaccggcgcacgtgccgaaaatattcagcatacggtttacaaaggcatgctgctgccgctggcgatgctggcgggcctgaccgtgctggtgcgtcgtcacagtaaaggcgatcagcataaggaggacgatgatgacgcatcatgatccgcagccgctgggcggaaaactcatcaataaggcgatcctgatcttcgcgccgctggtggtgctgtgcctgatccttatcggcaaacggctggtgttcggtctcggatcggtttccgatcttaacggcggctacccctgggggatctggatcgccttcgatctgttaatcggcaccggtttcgcctgcggcggctgggcgctggcgtgggcggtgtacgtttttaaccgcggcgaatatcacccgctggtgcgcccggcgctgctggccagcctgttcggttactccctgggcgggctgtcgatcaccattgacgtcgggcgttactggaacctgccctatttctatctgccagggcatttcaacgtcaactcggtgctgtttgaaaccgccgtctgtatgacgatctacatcggcgtgatggcgctggaattcgcgcccgcagtgctggagcgcctcggctggaaagtgtcgctcaggcgcatcaacaaagtgatgttttttattatcgcgctgggggcgctgctgcccaccatgcaccagtcgtcgatgggatcgttaatgatcgttgccgggcacaaagtgcatccgttgtggcagagctatgaaatgctgccgctgttttccctgctcaccgcctttatcatgggcttctccattgtgattttcgaaggatcgctggtgcagagcgcgctgcgcggcaggggcgcggatgaaaagccgctgtttatcaaactgaccgggctgttaagccttctgctggcgctgttcctgctgctgcgttttggcgaactgctctggcgcgacaagttgcactacgtctttgccggagacgtttactctgcactgttctgggttgaaaccgcgctgctggcgtttccgctgctggtgctgcgggtaacccgctggcggcgcgacagccgggtactttttctggcggcgctcagccagctgctcggctgcgcctgctggcggctctcttattcgctgctggcctttaaccccggcggcggctggcgctattttccgacctgggaagagctgctgatctccatcggctttgtggccattgagatctgcgcctacatcttactggtccgcctgctgccgatcattcctccgctacaacagcctgttcattgtcctcagggagcgagtaaagcatgagccaacgaattactattgatcccgttacccgtattgaaggccatctgcgcattgactgcgagatcgccgacggcgtggtgtcgaaagcctgggcctccggcaccatgtggcgcggcatggaaactatcgttaaggatcgcgatccgcgcgatgcctggatgatcatgcagcgcatctgcggcgtctgcaccaccacccatgcgctcgcgtcggtgcgcgccgtcgaaagcgcgctcaagatcaacgtaccgctgaacgcgcagtacatccgcaatatcattctcgcagcgcacaccacccacgatcatatcgtccatttttatcagttgtcggcactggactgggtggatattaccgcggcgctcaatgccgatccggccaaagcggcggcgctgctggcggggatctcccgctggccgctcaacagcgcggcggaatttacccgtgtacaaaacaaagtgaaggagctggtcgccagcggacaactggggattttcgccaacggctactggggacatccggccatgaagctgccgccggaggtgaacctgatcgccgtcgcccactatttacaggcgctggagtgccagcgggatgcgaaccgtattgtggcgctactgggcggcaaatcgccccatatccagaatctggcggtgggcggcgtggcgaaccccatcaaccccgacggcattggcgtgcttaaccttgaacggctgatgtacatcaaatcctttatcgacaagctcggcgattttatcgagcaggtctataaagtcgacacggcggtgatcgccgcgtattacccggaatggctggcgcaggggcagggggcggtgaactatctctgcgcgccggaatacccaaccgacagccagaacggcagctttttgttccccggcggggccattaccgatggcgatctcgctaccttccgcccgattaacgcccacagcagccagtggctgatcaacggcattcaggagagcgcgaaacatgcctggtaccaggacgacgaaccccaggctccctggcagggcaccacaaatccggctcacaccggctgggcggatgacggcaaatattcctgggtgaaatccccgaccttttacggcaaaaccgtggaagtcgggccgctggcgacgctgctgtgcaagctggcggcggggcggcaggagacccaaacgaaattgcaggaaattaacgacatttaccagcagctcaccggtcaacgcattgaggtggcacaactgcattctacgctgggacgcattatcggccggacggttcacgcctgcgaactgcagctgatcctgcaacatcagtaccaggcgctgattgccagtatcggtaaaggcgatcacctcacctgggtgaagccagtcatccccgaaacgggggaattttacggcgtcggttttctcgaagcgccgcgcggcatgttatctcactggatggtgatcaaggacggcaaaatcgctaactatcaggcggtggtgccgtccacctggaacgccgggccgcgcaacttcaacgatcagccggggccttatgaacaggcgctggtgggcacgcgcattgccgatccgcataagccgctggaagtggtgcgcaccattcactctttcgatccgtgtatgtcctgtgccgtgcatctggtggatacggacggcggcgatccggtatcggtaaaggtgctgtgatgaccattttagtgttaggcgtgggcaatattttgctcagcgacgaagccattggcgtgcgcatcgccgggacgctggcggcgcgttaccatctgccggagcacgtggaagtgcttgatggcggcacggcgggcatggagctgctggaggcgatggcgaatcgccgccatctgattattgtcgacgccattgtctcgcgtaaatactcccccggcaccgttctgacgctgcgcgacgacgaggtgccggtgctgttcaccaacaaaatttcgccccatcagctgggactggcggacgtgttatcggcgctgcgttttaccggcgagtttccgcgcaagctgacgcttatcggcgtcattcccgcatcgctggaaccgcacgtcggcttaacgccggtggtggccgccagtctggagcctgcgctggcgcgggtgatcgctgaactgcgtgacagcggggtgacgctggtggagcgtgcggcatgagcggcttttccggtgatccggcggagcaggtgcagacggcctttgcggcgatcggcgcacgcacgctgcacgatctggcgtttttgcatccggcaatgccggtatatgccgcgccctttaccctgtttgaagagcagtggatcggctgtctcatcacgccgtggatgctcagcgcgctggtgctgcccggcccgcatcagcgctggcagccgcgtccggtagggggaaaactcgccctcgcgctgcctgcgggaaacatcacctttaccgtcggcgagctggaaagcatcgggcactatctggcctgttcgctgatgtcgccggtgcagcgcgggctgacggcggcgcagggcataaatctgacgaacgactgcgcccgtatgctgctctcgctgccggtaaacaccccggatctgtcgcgccggcgggcgctgtttggctggcaggcgcgcgcccgtgcatgagctgtcgctgtgccagagcgtggtggaaattgtgctggaacaggcggcgcaggccggcgcccggcgcgtaacaggcgtctggctggaaattggcgcgctggcctgcgtggaagaaaacgcgctgcgctttagctttgccagcgtctgcgcgcagacggcggcgcagggctgcgcgttacatctcatccatcgcccggcgcaggcgtggtgctggacgtgcagcgcccgcgtggaagtgcagcgtcacgacgcggtctgtccgtgctgtcatggcgcgagccttagcgtggaaggcggcgaggcgctgcgggtgaaaagtatcgaaatcgaataaaaggaataaccgatgtgtataggcgtgccggggcagatcgttgcggttggggaggatcttcaccagctggcgacggtaaacatctgcggcgtacaacgacagattaacatcgcgctggtgtgcgaaggcgatcccgccgcgctgttggggaagtgggtgctggtgcacgtcggttttgcgatgagcatcattgatgaacagcaggcgagagaaaccctggcggcgttagagcagctggacagttaacggcggacgtcggtgatcatctgcgtcaccgcgctcaggttgccaatttttacatcgctggcgcgctgaaatttgcttttatcaatcagcaataacgactgctgcgcccggcttagcaactgcgttttgaatccggcattatgtaccgtcggatcccacatatcgccgtgggtatcaacaccctcgcaggaaaagataaacaggtcgatctcaagcgctttcagtaagggcgcgagcgtcggattcatgtagcagcggtatttacgatccagttcgccgccggtgcaaatcagcctgacgtgctggcggcgcgccatctcctgacaaacgggctggctgttggtaaatacggtcagcggcacgtccggcagctgtcgtgccagatgaaaacaggtggagctggcatccagcgccaggcacatcccttcctcgatccacgccagcgcatggcgggcaatatccgctttatccgcgtaatggctttttaaccgggcgacgaagggctcgccgccatcgtgattttgcgtgtggatcagccgcgcgcgcccgtgatgacgcacaattttcccctgcgcctgtaacgccgtgagatcccggcgcagcgtctctttgctgatgccgagctgtgccgccaggctggcggtggtcagggtgtcgtggcgggcgaggagcgccagaagggtttgttgtcgcgtggatttcatgcccggcctcaggctgtcagccgcggggagatggagatcagcgttgcgcccatcgccacgccgtttttgccgctgtgcttgatgtgatacatcgcctcgtccgcgcgggttaaggcttccacaaagctgtcctgcggctgcacttcatcaatgccaatggatgcgcccaccgatccgacgccgttatccagatcaaagggcgtcagcacggcgtgcagcagatcctgcgccgcgcggtggatcgtcgcatccgccagcgcaaagggcagcaacagcacgaactcatcgccgccgagccgcccgatagtggtgcccggcggacaggtgtcgcgcagacgctggctgagctggatcagcaatacatcgccgctacgatgcccgagggtatcgttaacatgcttaaaattatccagatcgataaaagccacgcacagcggcccggcctgtttacgctcgtcgaactgtttgatcagcgcgtgacggttggcaagtccggtgagcggatcgtgattggccagcagcgccagttgctcttcgtactgcttctctttggtcatgtcgatgtgtgtgccggtgaccttcagcggattgccgctggcatcccgctcgctgacgcgcccgcgatccagcacccaggtgatggtgccgtttttatgctgcatgcggtgcagggcttcgtagtaaggggctttgccctcaagatgatcgtaaaacgccttcagtacccagggacgatcctccggatgcagatgatctttccatacctcaaactgcgcgctgagctctttcggctgatagccgagcatcgatccccagcggcggttgaagatgatcagtttcccgctgggcacatccagctgccacaggcacaggccggtgccgtcgagggtagcgctgagtttactgcgggcgtcacgcgccagcctcaccagacgggcattatgctttttcagattctggatctgctgtgtcagggcgcgttcagacataggtgtccgcaatgaatgaaaaaaaatcattcttaccagttattattttgttgtaaatatgcggcgagaaaaagaaaccggcgggcggcagagaaaagaaaaaccgggcgtagttcgcccggttacacaggttagctgctgcgcttgtcttcggtgttggtatcgaagtcgctagcgtcgtgacgctcgtgcagctgttcgttcagcggcccgttggtgcggttgacgatgcggccacgcttcacggcggggcgcaccgccacctctttcgcccaacgtagtacgtttttgtagctgccggcatcgaggaactcggcggcgtcatagatggtgccgagcaccacgttgccgtaccacggccagatcgccatatccgcgatggtgtattcgtcaccggccacaaacttatgcttcgccagctgctgatccagcacgtcgagctgacgcttggcttccatggtaaagcggttgatggcgtactcgattttcaccggcgcatagtgataaaaatgcccgaatccgccgccgaggaacggggctgcgccctgtagccagaacagccagttcagcgcttcggtacgcccggccggatccttcggcaggaagtggccgtatttttctgccagatacagcaggatagatccggattcgaacacgcgggtcggcggagtagtggagtgatcgctcagcgccgggattttagagttcgggtttacctcaacaaagccgctggagaactgatcgccttcgccaatacggataagccaggcatcgtattccgcggcggtcacgcctttttccagcagctcttccagcagaattgtcaccttctggccgttaggcgtaccgagggagtagagctgaagtgggtgcttgccaactggcagggttttttcatgcgtggcgccggataccgggcgattgatgctggcaaaggcgccgcctgcggatttatcccacgtccaggttttcggtggctgatactgattgtctgacatgttaacctgccttttcattgatgtgttgaagcagtgtagcaggcgctacgcgcagaaacggacggttagtgcgcttaacgccaggtcgttgttattcaggaaaaaaggcgttcagcccagacggtgacgtcatctccgctgcccagatccggctgcaccagaccgttgaccataaaggtcggtgagacgtgaatgccgttctgacgggcatatttgcagtgccatttaatgacggtttgcagatccgcccggccaaagggtaccgaggcatccaccccgctgtaagctttaaggcgcgccagaatatcgtttggcgtggcgtccatattcggaccgctgcaatgatcggtaaattcaaactcttcacggtgatcggccaccgcctgcatgactttatgcgccgcgtcgcgcccgtccggcagcgtcgaggccgcaaggatatagcgcacgatcacgccggaatacagatgccacggttgggattgcagacggattttaatggtgacgttatcttcgccgacatgctgtaacagcgcgtccagcttgttaaaggctttgacggagaacggacaggtaggctcaagaaaaacttcaaaggtgcgtggcccgtggccccactccagcggttgcgcgttaagggcagcttgctgactcatgttaactcctgatgttgtgtgtgtttattcactatatcaaaagcgtgatgaatgtttttagcatggcgggcagagaaaggaaaaggcacgctggcgtgcctttttaatctttatgggcaggtccttgacgtaacatcaaaccttaagcattttcaccgtcgcatccacgtcgatctcatcttccgtaaagattaacgtctctccctggaaggtggtgatcgccagttttttcagcgtccgcatttgtcccggcttgatatcggtttttgggcgaatgttgcccatcagcagccctacggacagcacggtattttctttatcgatgcgcgcctcgacggggacttcttcgctgaaaaccacgtaagatttgatggccgtaagcttaatgcgctcaccggcgataaagatgtatttgctttccggcagcactttcactgcgtaggcggacaggcctttattattggtggtgggttcaaaggtcaccgccgcatctttcttgatgagttcagggttggcgaccttaatcacatgaaaataacggttatccccgttttcatctttgagaaatccaaaacctttgtctttgaaccaggttgtgattgttccgttcatcgccattaccgcctgtttaatcgtttatctgctcagttcttgccgcgcgcagtgtaatgcacaacgcctgcgcgtactacgttttgcttaccacatcaaatcatcaggtactttgaaatctgcatacggatcgtcttcatcctgcgcttcctgactcaacgcactgttgaggacaatactttctgcatcccgctgcgcaattttatcggcaacgcttgccggaataatggcgtattcactctcgccgctgctgtctttcatcagacgcgcaatagcaagacgtccgctaatcaactgcgcctgggtcaccttatcgacggcgatttttttaataaagttattgtcggtaaagttgaaatcaatattgcctctggcaatgttgatgcggttcatctcaatcagctgcttcacctgcgctttgtactctttggacaacgctgcttgtttttgctgttcgctcagcagcttgtcgcgctccagctgtgcctttttattctcttccaccgcagcacgggcttcacgcgtctgcacgcgggatttcttcgccgtgcgctgcactttggccatttttttgctggtcaccaggcccgctttcagcatctgctcttgtaaggtaagtttggtcatcgtcgtttctgaactcattggataatttttgtcattatacccgcaattgctgaggctgtgacaggtaccgatggaggcgggggagtaggagcgcagcgggcagaacgtccaaaagcaaaaacccgccttgtgggcgggttctttaaatagtggtgcccggactcggaatcgaaccaaggacacggggattttcaatcccctgctctaccgactgagctatccgggcaacggggcgcattaaacctgatccgcctcgtgtcgtcaacgaaatttatttaaatcgttgcagactgcacaatctatcagcaatctggcgtcactgcacgcggttcaggcgaaaaaagcgctccaggcggcggagatcggcatggcgataatcaacgcgggcagcatgttagcgacggcaaacatcttgataccgcagatacgcaggccggtggccagcagcagaataccgccgacggcagtgaaatcgcccatcatcgccggtgtggtgagcggcagaataaaggtcgcgcaggtggcgagggtaagctgaataatcagcatcggcaccgaaatggccgccacggcaatgcccagcgaggtggcaaaaatcaccgcggtaaagaagtcgagaaaggctttggcgatcaaaatactcggatcgccggtcatgccttcgcgcatcgcgccgaaaatcccggtgccgctggcgcagaacagaataatgatggcgaccagactttcgataaaagcgtcatgaccttccggcacgccggttgattttttgccgcgctgcaccagtttacgcaggcggttcaccccgccgctgatgccgcgctcgacgtaacagatctcgccaatcagcgtgcccaccagggttgccagcaccatcaccggcaggttgacgcatttcattaccagaagaatgccgatacccagcgagcacaggccgaaaatggcgggcatcgaaccacgcacgcgttcgggtaagcggtggcttaacaccgcgccgagggtgccgccgattagcacggcagcggcattgataaaggggccagttaacacgctgttactcctgaacaatttgtttgcactattgcatagtatgccgcaaaaactcaggttccaggcattttttgcgtgttgcacctgccggtcaaaagtgacattattgcgcgaaatttcctctcttaatcacggggccgcctggatgacaccacattctgctcgccagacctgtcgcataattatgcgatcgcgtacccgttctgccatgatccatactcttctcaccatgcggtgagggcaacgcaggctcatccgagggcaaccgtaaaggcagacgcgatctgtttttactgatgtctggcgattggagctggctccagtcagataccttcattgggtgagatcgccatctcgcccggggctttttactcccctgaaacgggtaaacgtgcttatgaaaaccatgaaaattgccgccagccgcgagctggtttcccagctttccacccatcgcgaggtggtcagcctggacaacacggattttaccgacgtggcggcagtcgtcattacggtggctgacagttacagcggcattctcgcgctcttaaaacgtacaggctttaagctgccggtattcctgttcagcgacacgcctgccgatgcgccagcgggcgtcgaggcggtgatcggcggtaaagcgcaggagatgctggagctggaatccgcggcctgccgttacgaagaaaacctgctgccgccgtttttcgataccctgacgcagtatgtggcgatgaacaacagcacttttgcctgtccgggacatcagcacggcgcgttcttcaaaaaacaccctgccggacgtcagttttttgacttcttcggcgagaacgtttttcgcgctgacatgtgcaatgccgacgttaagctcggcgatctgctgatccatgaaggttccgccaaacacgcgcagaaatttgccgccaaagtgttccatgcggataaaacctactttgtgctgaacggcacgtcggcggcgaacaaagttgtcaccaatgcgctgctgacgcgcggcgatctggtgctctttgaccgtaacaaccataaatccaaccaccatggcgcgctgatccaggcgggggcgaccccggtctatctggaagcggcgcgtaacccgtttggctttatcggcggcattgacgagcactgtttcgacgagcgttacctgcgcgagcagatccgcgccgtcgcgccgcagaaagcggacgatgcgcgcccgttccgcctggcggtgatccagcttggcacctacgacggcaccatctacaacgcccgtcaggtgatcgacaagatcggatcgctgtgcgattacatcctttttgactcggcgtgggtgggctacgagcagtttattccgatgatggccgactgctcgccgctgctgctggatctgaatgaaaacgatccggggatcttcgtcacccagtcggtgcacaagcagcaggcgggcttctcccagacctcgcagattcacaaaaaagataaccacattcgcggccaggcgcgcttctgcccgcataaacggctgaacaacgcctttatgctgcacgcttccaccagcccgttttatccgctgttcgccgcgctggacgtcaatgccaagatccacgaaggtgaaagcggccgccgcctgtgggcagagtgcgttgagctgggcatcgaagcgcgcaaggcgatcatcgccaactgtaagatgattaaaccttttgtgccgccggaagtggcggggcgaccgtggcaggatcacccgactcacgccatcgccagcgaacgtcgcttcttcagctttgagccgggggcgagctggcacggttttgaaggctacgcccgcgagcaatattttgtcgatccctgcaagctgctgctcaccacgccggggatcgatgcgcagaccggtgactacaccgatttcggtattccggcgaccattctggcgcactacttgcgtgagaacggcatcgtgccggagaagtgcgatctgaactcgatcctcttcctgctgacgcctgccgagagcgcggagaaaatggcgcagctggtggcgatgcttggtcagttcgagcagcacattgaagacgatacgccgctggcggacgtgctgccgaccatcttcaacaaatatccggtgcgctaccgcgattacaccctgcgcgagctgtgtcaggagatgcacgatttgtacgtcagctttgacgttaaagatctgcaaaaagcgatgttccgcgccgacagtttcccgccggtggcgatgaatccgcaggatgcgaacagcgagttcattcgcggcaatgtggagctggtgcgcatcagcgaagccgaagggcgcatcgcggcggaaggcgcgctgccgtatccgccgggcgtcttatgcgtggtaccgggggaagtgtggggcggtgcggtacagcgctatttcctcgcgctggaagagggcgtgaacctgctgccgggcttctcgccagagctacagggcgtgtatagcgaaacagacgccgatggtatcaagcgtctgtttggctatgtgttaacagagaaataaaaccggaatgccttacctgcgacgatagctcttctgcgcggtatccactttatagagatagcggcgcgattcagcggacggatgccgcgtggtgagtgcttcgtacacatcccccggcgtcatgcggttaataatgttcgccgcctgcaccttatcgctggagaacacccgcagcacgctgcccgcgccgccgttataggcggtgatcaccgcataacgccgtgaggtcgggttggtaatgccggacagataaacattgttcagcatcgccagataagccgtgccggtatcaatattactcgccggatcgaacaggaagttgcggtccggcatcccggagcgaccctgggcgcggaacacgtctttcccggcgctgtgctggacaacctgcatcagccccagcgcatcggagcggctgacggcgtacgggttaaaggaggattcggtctgcataatggccaggataagcgattcatcgacgccatacttgcgtgacgcctgacgcaccatgccggtgtatttatgggcgcgtttatccaggtggttcgccaccagattaatggtcacgctgtagatcactttcagcccgttctgccggcttttcatgcgcgtttgcagcagataatccgcgtaacgtgccgcgcgccactgccagcgaatggcctcgccattgttatccactacctgtccgtagaggaacggctgtttggaaataggaatgtcatcgacatcggaatagaggtcgatagagccgggatcgtcacccatcaacagcgtcttgatgatcgccttgcgcaggtgcgccgcaggatctgtcccggcgatggtttcgatggtgatcgagccgtcatcaaagttgatgtggctgcgggtctggtactgatcggtgtacttaacgtagtccttggggccggcaatcaggacttcgttaaatccccagatattttcgatgttatgggcgaactgccccatcagaatgtcaaaaccgttggtgtcctttacccaggcttcgttatagctatcgcccttattgttggaactggaacacgagatgagtaacggcgcgatcagggcaaacgctaaatattttttcatcattccgcaggtgcgtgttgtgttggtgttataagtgaaaaagccgggttaccccggcaatgttattcttattcctgcggcttatagccttcgatgtgcacgtctttaccttcgaacaggaagttgatcatctcctgctccagaagtttacggtgctccaggttcatcatattgagtttcttttcgttgatgagcatggtctgcttctgctgccactgcgcccaggcttctttggaaatctcgttatagatgcgcttaccgacgtcgcccggataaagctggaaatcctgaccttccgcttcacggcccaggaaggtacaaaaaatggttctgctcataaaaattcctctttcatctcagcgctatacagcggcgccggtacgtaattgctgtaacaggcgctcaacgggcgccgccagtccgacggattgcggttgcgctaagttataccagagacccgctccttcatccatgcatgcggtgaatgaggacacgggaagccacattggcacaatatccagatggaaatggctgaaagtatggcgaaacgccgttaactggctgagagtatcggcgctaatctgacgttctgccagccagtgacgcagactgtcttcatcttcgaactgcggaaagcagaataatcccccccacaggccgaccggcggacgctgggccagaaacacctcgtcgccgtgctgaagcatcagaaaatagccggtgcgctccggcagcgtctgcttcggttttttgcccggatacagcgcccagctctcatgttgatacgcttcgcagccattattgagcggacaaagcgagcacttcggttttgaacgggtgcagaccatcgcccctaaatccatcatcgcctggttaaagcgcgccacgccctcggcgggcgtcacctgttcgctgatgtcccacaggcgtttttccacctcttttttacctggccagccgccgaccgcgtagcagcgggccagcacgcgcttcacgttgccgtcgaggatcgggaaatgtttattgagcgacagggataaaatcgccccggcggtagagcgcccgacgccgggcagcgccgccacttcctcaaaggtgtccgggaactgtccgtgatgcagcgtcgccacctgctgcgctgccttatgcagattgcgcgcgcgggcgtaatagccaaggccggtccacaggtgcagcacctcatcaaggggcgcattggctaaatccgtcaccgtcgggaagcgcgccataaagcgctcaaagtaggggatcacggtggtgacctgcgtttgttgcaacatcacctcagagagccatactttgtagggcgttttttcgagttgccagggcagagttttacgcccgtatttgtcataccactccagcacctgggctgaaaattgcgacgcgtttaaggtcaaagcagggattccgggtaacgatttggaggagccagattgcagcacagcggcacagaggtgtaaaccagaagtttccggtgcttgcatccggcaactaactttggataatgcccgtttcccgaacactctcacaagcagacatatttatgaagaacgacgtcatttcaccggaatttgatgaaaacggtcgcccgctgcgccgtattcgcagctttgtccgccgccaggggcgtctgacgaaaggtcaggagcacgcgctggaaaacttctggccggtgatgggcgtggagttcaccgaagaaccgctggatttcgctgcgctgttcggccgcgacgcgccggttacgctggagatagggttcggcatgggggcatcgctggtcactatggcgaaagcgaagccggagcagaatttcctcggcattgaagtgcattcgccgggtgtgggcgcttgtcttgccactgcccatgaagagggtgtcgagaacctgcgcgtgatgtgccacgacgcggtagaagtgctgcacaaaatgatccctgacaattctttaaccatggtacagctctttttccctgacccatggcataaagcacgtcataataaacgccgtatcgttcagccgccgtttgcggaactggtgaaaagcaaactgaagctgggcggcgtattccatatggcaaccgactgggaagcctatgcagaacacatgctggaagtgatgtcatcgctggacggctataaaaaccagtccgccagcaatgactatgtgccgcgtcctgaatcgcgtccggtaaccaaatttgaacagcgtggccatcgtcttggtcacggcgtatgggacttaatgttcgagagggtgaaataatggcaacgaaccgtagccgtcgtctgcgtaagaaaatgcatatcgacgagtttcaggaattaggcttttccgtcgcatggcgtttcccggaaggcaccagtgaagagcagattgaccagaccgtggatgacttcatcaatgaagtgatcgagccgaacaaactggcgtttgacggcagcggttatctggtgtgggaagggctgatttgcaaacaggaaatcggcaaatgcactgaagagcaccaggccattgtgcgtaaatggctcgaagatcgtaagttcgacgatgtccgcatcagcgaactttttgacgtctggtgggactaagtacataccgaaagggccggcacatgccggcccattttgtctctgaaggagtttttatgttgcgcaaaacgctgctggcggctgccctgacggtaaccgcatttaccgcacaggctgaatataaatgtagcgtcacgccgcgtgatgacgtggtggtaagcccgcaaaccgtgcaggtgaaaggcgagaacggcaatctggtgatgacgccggacggcaacgtgatgtttaacggcaagcaatacagcctgagcgccgcccagcgcgagcaggcgaaagattatcaggcggatttacgcacggcgctgccgtggatcgacgacggtgcgcgtagccgcgtcgaaaaaggccgcgtggcgcttgataacatcatcgctaaagaagtgggtgaaagcagcaatatgcgcggtcgcctcaccaaactcgacgcgcagttaaaagagcagatgaaccgcattcttgagcgtcgtcctgacggcatcaccttccattacaaagccattgatgacgtgcgtgctaacggccagcagctggttaatcaggcgatgggcggcatcctgcaggacagcatcaatgagatgggcgcgaaagccgtgctgaaaggcggcggcaatccgttgcagggcgtgctcggcagcctcggcggattacagaccgcgatccagaacgaatggaagaatcaggaagctgattttgaacagttcggcaaagccgtgtgcagccgcgtggtgtcgctggaagaaagccgcaaagcgctggtcagcgggctgaagtaaggtttttcccctcaccccagccctctcccggagggagagggagaaatcatccgccggctggtcccctctccctggggagagggtcagggtgaggggagtttcaaaaatctgccggcgctttaaacgtcatactgttgccaaaagccggatgggtgatggtcagcatttccgcatgcagttgcaggcgcggggccatcgccagcgcgtcaggtgtggcgtaaaaccgatcgcctaagatcggatgccccagcgcctgcatatgcacacgcagctggtgggaacgcccggtgatcggctttaactctacgcgcgcgctgttgtccgccgcatactccagcacacgatattccgtctgcgccggtttcccggtttcataacacactttttgcagcgggcgattcggccagtcgcaaatcagcggtaaatccaccagaccctcttcttttgccggatggccccacacgcgcgccacatactgcttcttcggctcacgctcgcggaattgccgcttaagctcgcgctcagcggctttgttcagcgccaccacaatcacgccgctggtagccatatccagacgatggacggattcagcctgcggataatcgcgctgaatacgcgtcatcacgctgtctttatgctcgtcaagacgtccgggcacggacaacaggccgctcggcttgttgaccaccataatgtgctcatcctgatacagaatgaccagccacggatcctgcggcggattgtagggttccatcaacattgcaggctccggttactgatgcgtcacgacgatcaaacgcagggcatcaagacgccagcccgcttcggccaggctctccatcacctgctggcgattgctttcaatggccgccagttcatcatcacggatgttcgggttgaccgctttcagcgcttccagacgggagagttcagcagagagcttctcatccgcttcagtacgcgcggcttcgatcagcgctttcgcggctttttcgatctgcgcttcgccctgttgcagaatggcgtgcacgtcctgctgcaccgcgttcaccagcttgctgccggtatgacggttcaccgcgctcagctgacggttaaaggtttcaaactccacctgtgccgccaggttgttgccgtttttatccagcagcatgcgcaccggggtggcaggcaggaaacggttaagctgaagctgtttcggtgcctgagcttccaccacgtagatcagctccagcagcagcgtccccaccggcagagctttgtttttcagcagcgaaatggtgctgctgccggtatcgccggagaggatcagatccagaccgttgcggatcagcgggtgctcccaggtgacaaactgcgcgtcttcacgggacagcgccacatcacgttcaaaggtgatggtgcagccatcttccggcaggccagggaaatccggcaccagcatatggtcggacggcgtcagcacgatcatgttttcgccgcgatcgtcctgattaatgccgacaatatcgaacaggttcatggcaaagctgatcagcgccgtgtcgtcgtcctgctcttcaatgctttccgccagagcctgcgctttttcgccgccgttggagtggatctccagcagacgatcgcgcccctgctcaagctgggctttcagcgcgtcgtgctgctcgcggcaggatttgatcagatcgtcaaagccgtcggtgttttccggcgctgccagatagccgataagatcggtatacaccttgtcataaatcgcgcggccggtcgggcaggtgtgttcaaaggcgtccagaccctcatggaaccagcgcaccagcacggactgggcggttttttccaggaaaggcacgtggatctgaatatcatgcgcctgaccgatacgatccagacgaccaatacgctgctccagcagatccgggttgaacggcagatcgaacatcaccaggttactggcgaactggaagttacggccttcggagccgatttccgagcacaacagcacctgcgcgccgctgtcctcttcgccgaaccatgccgctgcgcggtcgcgttcaatgatcgacatgccttcgtggaacactgccgcacgaatgccttcgcgctcgcgcagcacctgctcaagttgcagcgcggtggcggctttggcgcaaatcaccagcactttctgcgagcggtggctggtcagataacccatcagccattcgacgcgcggatcgaagttccaccaggtgccggaatcgccttcaaattcctgataaatctgctccggatagagcatgtcgcgggcgcgctcttcggcgcttttccgcgcgcccataatgccggagactttgattgccgtctgatactgcatcggcagcggcagcttaacagtatgcagctcgcgtttcgggaagcctttcacgccgttacgggtgttacggaacagcacgcggctggtgccgtgtctgtccatcagcatgttgatcagctcctgacgggcggattcagcgccgtcacggttgctgttggcggtttgcagcagcggttcaatgtcctgctcgccaatcagttcacccagcgtgttcagctcgctgtcggtaagggtttttcctgccagcagcatggcgaccgcatcggccaccgggcgatagttattttgttcttcaacaaactgcgcaaagtcgtggaaacggttcggatccagcaggcgcagacgcgcgaagtggctctccagtcccagctgttccggcgtcgcggtgagcagcagcacccccggcacacgttccgccagctgttcaatcgcgaggtattcgcggcttggcgcatcttcgctccacaccagatggtgggcctcatcgacgaccatcagatcccattcgccgtcgcacaggtgctccagacgctgcttgttgcggcgcacgaagtccagcgagcaaatcactaactgctcggtttcaaacgggttatcggcgtcgtgctgggcttcggcgtagcgctcgtcgtcaaacagggcaaaacgcaggttgaagcgccgcagcatttccaccagccactgatgttgcagggtttccggcaccacgatcagcacgcgctcggccgcgccggagagcagttgctggtgcaggatcatgcccgcttcgatggttttccccaggcccacttcatccgccagcagtacgcgcggcgcatggcggcggccaacatcgtgggcgatatgcagctggtgcgggatcaggctggtacgctgaccgcgcaggccgctccacggcatccggtactgttcgctctggtacttacgcgcgcggtagcgcagcgagaagcgatccatacggtcgatttgaccggcaaacagacggtcctgcggtttgctgaacaccagtttgctgtccagcagcacttcgcgcagcatgacgttcgcctcgccggtatcctggcgtgtacctatgtaggcgaggaggccgttttctgcttttacttcttcaatattgagctgccagccttcgtggctggtcactgtgtcacctggattgaacatcacgcgggttacgggagcgtcgctacgggcatacaggcggttttctccggtggaggaaaaaagcagagtgacggtacgcgcatccatggcgacaacagttccaagtcccagttcgctttctgtatcgctgatccagcgttgaccaagtgtaaaaggcatatgtattcggctctatatctctaattgcaggcaatagtttgaccaccgtctgaaagcgacggcacatcaaaatttggggccaggattgggaagggcgctatggtactggaaggcacagctttcgtcaccttttcgtcatcattcaaaataacccaagctggccggtaacaagtgtagcaaaatcatcgtggaggaaaggcagaatgccgtccgccaccggttgtagctgtttggtcagatagtgatcgtagtccagcggcgactgctgataggccaccggctccgggccgttcgtcgtccagacgtacttaatggtgccgcgattctgatactgcaacgcgcggcccattttctggttatgttcatccgccagccgtgctgcgcggacgtgtggcggcacgttgcgctgatactccgccagcgggcggcgcaggcgtttacggtacaccagccgatcatccagctcgcccgccatcagctgcgcgatggtttcccgcacataatcctgatacggctcgccgcggaaaatgcgcagatacagcgactgctggaactgctgcgccagcggcgtccagtcggtgcgtaccgtttccagccctttaaacaccatgcgctggctgtcgccttcctggatcagcccggcataacgtttcttgctgccggtatccgccccgcgaatggtcggcatcaggaagcggcaaaaatgggtttcaaactccagctccagcgcgctggtcagcccggactgttgcagatgtgtctgccaccaggcgttaacgtgcgccaccagcgcctgaccggtttttgccgcctcttcttcgctgtgcgcgcctttcagccacacaaaggtggaatccgtatcgccatagatcacatcaaaaccctgcgcttcaattaacgctttggtctgcaacatgatctcatgcccgcgcagggtgatggacgaggcaagccgcggatcgaaaaagcggcaggcgctggtgccgagcacgccgtaaaaggagttcatgatgatcttcagcgcctgggacagcggtttattgttgaggcgtttggcctcatcccgcccctgccagacctggccgatgatctccggcagacagtgtttttcccgtgaaaaccaggcgtcgagaaagcccggtatgctgtgctgcggatccggctgcgccatgccttccaccagcccgaccggatcgatgaggaaggtgcggataatggccggataaaggcttttatagtccagcaccagcaccgaatcatacagccctggccgcgaatccattacgtagccgccggggctggcctgcggcggcacatcgccgaggttgggcgcgacgtagcccgcgcggtgcatccgcggaatataaaggtggctgaaggcggcgacggatccgccatggcgatctgccggcagaccgttgaccgtggcgcgctccagcaggaagggcatgatggcggttttatggaaaatacgcgtcaccagctcgcagtctttcaggttataagtggcgagagcgggtttgttttcggcaaaacggcgttcgatctcatccatgcgatcccagggattatcaatagctttaccttcgcctaatagttcctgcgacaccgcctccagcgaaaacgacgggaagctccagaacgctgatttcagcgcatcgatgccgtcgatgatcaaccggccattggcctgggcgaagaacacgccgtttttaaagccatgctcgcgccactccagatcggtgctgccgcgcccaagacgcagcggaataccgtaacgctcggcatgtttttgcagcacgcgcaggtcgaactgcaccacgttccagccgatcaacacatcgggatcgtgagcggcaaaccaggcgttgagtttttccagcagcagcgggcggctggagacatactccagatgaaaatccacgccgctggcgtcgccattttgcggaccaagcatatagaccgtgcgctggccgcagccttccaggccgatgcagtacagctcgccatgacgggtggtttcaatatccagcgacacccatttcaggggcggacgataagcgggatgcggctttaagcgcgcgttgatcagcgaaccgttgtgcgcgtcgccgtcgacccacaccggcgcggtaataaagcgctccatcagaaaacgctccggcgggcggatatccgcttcaaacaccgtgacgccgccttcgcgcagcagtttgtcgtagcgcatcagctggcgatgggcgcggcaataaaggccgtgcaccggctggcgatggaaatctttcagcgccagcggcgtgaggcggtactgggattcaccggcgagaatgcgctgcgcctgcggcacctgttcggaggggataaacgccaccgattcctgcggcggcagcaccacgtgcagcggcccgtcatccgtggccagccagaattccacctcggtccctttgggggtatcccgccagtgccgggtcagtaaaaagccttctcgcgcctgcgccacaccgtgctctcataaaaataaaccaggcataattatagcctggttcggaggtgggtgctggtgttttatacaggtattactgcccgtagtaggctttcgcgccatgcttgcgcagatagtgcttatccagcagggtttgttgcatcgcggggagatccggcgtcagctggcggctgaaaatgcccatataggccacttcttccagcacgatggcgttatgtaccgcgtcatcggcgtttttgccccacgcaaaggggccatgggaatgcactaatacgccgggcatctgtgcggcatcgataccctgtgtcctgaaggtttcgacgatgacgttacccgtttcccactcgtattcgccgttgatttccgcgtcggtcattttgcgggtgcaggggatcgcgccgtagaaatagtcggcatgggtggtgcccgtcgccgggatggattgtcccgcctgcgcccagatggtggcgtgtcgcgaatgggtatgcacaatgccgccaatggacggaaaagcctgatacagcaggcgatgggtgggcgtatcggacgacggttttttattaccctcgaccacttcaccggtttcaatgctgaccaccaccatgtcttcggcggtcatcacgctgtaatcgacaccggatggtttaatgaccaataccccgcgttcgcgatccacggcgctgacgttaccccaggtgagcgtcaccagattgtgctttggcagcgccaggttggcgtccagcacctgacgtttgagatcttctaacattcatctctccacgccggatggcgcgttgcttatccggcctacataaacaacgcgccatcgggcattaaccattaacgtttcgaaccgtaatacacctcgttccagcgcagcgcgtctttgaacgcgggcaggcgggtgtcgttgtcgatcactgtcagttcaatgccgtgcagttcgctgaactggcgcatatcctccagatccagcgcatggctgaagacggtgtggtgcgcgccgccggcgatgatccaggcttcggaagcggttggcagatccggctgggctttccacagggcgttggcgaccggcagcttcggcagcgcatgcggcgcttcaaccgagtcaacgcagttcaccagcagacggaaacgatcccccagatcgatcaggctggcgttgatcgccggacccgttttggtggagaagatcagacgggccggatcggctttgccgccgatgcccagatactgcacgtcgaggatcggtttttcgtccagcgcgatggtcggacacacttccagcatgtgcgagccaagcaccagatcgttgccgttctcaaagtgataggtgtagtcctccataaaggaggtgccgcccggcagaccggtcgccatcaccttcatgatgcgcagcagcgccgcggtcttccagtcgccttcacccgcaaagccgtagccctgctgcatcagacgctgcaccgccagacccggcagctgttttaagccgtgcagatcttcaaaggtggtggtgaacgcgtggaatccgccctgttcgaggaagcgtttcatgcccagctcaatgcgcgcggcgtcgataacgttctgccgtttatcgccgttgatctgcgccgccggggtcaggcggtagctgctttcatattcatccaccagcgcgttaatatcgccgtcgctgatgctgttcaccacctgcaccagatcgcccaccgcccaggtattcaccgagaagccgaatttgatttgcgccgcgactttatccccgtcggtcaccgccacttcacgcatgttgtcgccaaaacggcacactttcagatgacgggtgtcctgtttcgacaccgcatgacgcatccacgcgccgatgcgctgctgcgctttttgatcctgccagtggccggtcaccacgctgtgctgttgacgcatgcgcgcgccgataaagccaaactcgcggccgccgtgcgcagtctggttgaggttcataaagtccatatcaatgctgtcccacggcaggctggcattgaactgggtatggaactgcaacagcggtttattgaggatggtcaggccgttgatccacattttggccggggagaaggtgtgcagccacaccaccagacccgcgcatttgtcgtcatagttggcgtcgcggcaaatcgcggtgatctcatccggggtggtgccgagcggtttcagcaccattttgcacggcagcttcgcctctttattcagggcattcactacctgttccgcgtgggtggtgacctggcgcagcgcttccgggccatacagatgctggctgccaatcacaaaccacacttcatagttatcgaaaacggtcatttatcgtgtccttaatgagtcagcgctgcctgcgatgcgggggcagctgaagggagatagtgttgttcggcgcttaccgcccactgttgatagcggcgatagagctgttcaaaacgttgcgcctggcgcgggtccggttgcagggtgttttcgatgcggctggccatcgactgctgggcggtgggaatatccgggtgatcgcccgctgccacggcagcaaaaatagccgcacccagggcgcagcactgatcggaggcgacaatctgcagcgggcggttcagcacgtcgcagcaggcctgcatgatgacgcggtttttacgggcgatgccgcccagcgccatcacgttatttaccgcgatcccctgttcggtgaagcactccataatggcgcgcgcgccaaaggcggtggcggccaccagtccgccgaacagcagcggggcgtcggtggcgaggttgagatcggtgatcacccctttcagacgctgattagcatccggtgtgcggcggccgttaaaccagtcgaggatcaccggcagatgatccagcgacgggttatccgcccaggcctgggtgagcgccggtaacagctgtttctggctggcgcggatctgcgttttcagctccgggtgttgcaacgccagctgctccagcggccagccgagaatgcggccaaaccaggcgtagatatcgccaaaggcggattgcccggcttcaagcccgataaagtccggcaccacgctgccgtccacctgaccgcagatgcctttaacggcgcgatcgccgacgctcggtttatcggcgatcaggatgtcgcaggtagaggtgccgatcactttcaccagcgtgttcggctgcgcgcccgcgcccactgcgcccatatggcaatcaaaggcgccgccggcaatcaccacgctttgcggcaggccgaggcgctgcgcccattcggcgctgagcgtgcccaccggaatatcggcggtataggtgtcggtaaacatcgggtagctgagatgtttgttgatcagcggatccagctcatcgaagaaactggcggggggtaagccgccccagctttcatgccacagggatttatggccggcgctgcaacgaccacggcgaatagcctgcgggcgggtggtatcggagagcagggcagggatccagtcgcacagctcgatccaggaggcggcggcctgcgccaccgcggcgtcggcacgggtcacatggaggatcttcgcccagaaccattcgctggagtaaatgccgccgatataacgggagtaatccacttttccggcggtgtggcacaggcgggtgatggcttcggcttcttcgacggcggtgtgatctttccacagcacgaacatggcgttcgggttatcggcgaactccgggcgcagggccagcacgcggccttcggcatcaatgggcgcgggagtggagccggtgctgtccacgccaatgccgctgacctgcgcgcggtgctctgcgctcagttccgccagcacgcttttcagcgccgcctccatcgactcgatgtagtcgcgcgggtggtggcggaactggttatgaggagcgtcgcaataacgcccttcctgccagcggggataccattcgacgctggtggcgatctcctcgccgctgacgctgtccacggccagggcgcgaaccgaatcgctgccaaaatcgaggccaattgcaattgccatcgtgttactccatcaagaataagcgtatggagaaacattagagacagacgccggaaagggtcaggcaggatccgctaatcttatggataaaaatgctatggcatggcaaagtgtgacgccgtgcaaataatcaatgtggacattccgcctggctttatagacacttttgttaagccttttttgccggtgtgtggaaacaaaaccgggcaaagtgcttttatctggcggggttggtgaaggctgttttacctgcggaaggcaccgccgggggatttgatgatacaaatcacaatatggacaattggtttcctttaatgacatccggagtattgccattatggctgaaccgcaaaacgatccgctgctgcctggctactctttcaatgcgcatctggtggcgggattaacgcccattgaggcagacggttacctggattttttcgttgaccgcccgctgggcatgaagggctatatcctcaacctgacggtgcgcggcgaaggcatcatcaataacaatggcaaagagtttgtctgccgtcccggcgacatcctgctctttccgcccggcgaggtgcaccattacgggcggcatcctgacgcgcgggagtggtatcaccagtgggtttatttccggccgcgcgcctactggcatgaatggctggcgtggccgacgattttcggtcagaccgggattttccgtccggacgaggcgcatcaggcggccttcagcgagctgttcgaccagattatccatgccgggcagagcgccgggcgctacgccgagctgctggcgatcaatctgctggagcaggtgctgttgcgccgtatggaagccattaatgaatccctgcatccgccgctggataaccgcgtgcgcgatgcctgccagtacatcagcgatcaccttagcgacagccattttgacatcgccagcgtcgcccagcatgtctgcctgtcgccgtcgcggttatcacacctgttccgccagcagctgggcgtcagcgtgctgagctggcgcgaggatcagcgtatcagccaggccaagctgttgctcagcaccacgcggatgcctatcgccagcgtcgggcgcaacgtcggctttgaagatcagctctatttttcccgcgtgtttaaaaaatgcaccggggccagtccgagcgagtttcgcgcaggatgtgaatgaaacgtaaatgaaacgaaaagagatgtccggtggtctgagttaaccagtaaactacttatcagatcatttaatcgggcaggttatgcaggcatttctggaacattttattacgcagtcggcggcgtattcccttatcgccattgcgctggtggcgttttttgagtcgctggcgttagtcgggctgattttacccggcacggtgatgatggcggggcttggggcgctgattggcagcggcgaggtcaatttctggtatgcatggctggcgggcatcgtcggctgtctgctgggcgactggatctccttctggctcggctggcgctttaaaaaaccgctgcaccgctggtcttttttaaagaaaaacaaagcgctgctggataagaccgagcatgcgctgcatcagcacagcatgtttaccattctcgtcgggcgttttgtcgggccgacccggccgctggtgccgatggtggcggggatgctggatctgccggtggtgaaatttattctgccgaacattatcggctgcgtgttctggccgccgttctactttttgccgggcattctggcaggcgcagccattgatattcccgcggatgagcagagcgggggcttcaaatggctgctgttgctggccgcggtgctgctgtggctggcggcctggatgtgctggcggttgtggcgcagcgcgaaggccagccccgacaagctgacgcgctttctgccgcgcgcccgtctgctgtgggtagcgccgctgctgctgggtgtggcggtggtggcgacggtggtggtgatccgccacccgctgatgccggtgtatgtggatattctcgggaaggtcgtcagggggcattgacggggcattgccgggtggcggctgcgccttacccggcctacacgaacatcattgcttcaggtttcgtaggcccggcaagcaacgcgccgccgggcaacacggcccaatttacacgaacatcattgcttcaggttttgtaggtccggcaagcaacgcgccgccgggcaacacggcccaatttacacgaacatcattgcttcaggttttgtaggcccggcaagcgacgcgccgccgggcaacagggctccattattccacccgcacattcacatgcccgaacgggggcacctgatgaacggccagcggctcacccagcgcattgcacgtctgccatccttccggcacggttagcgagtgctcaccagggttaaacagcctgaccagcatcccgccatacagcacatccacgccgctgaccgccagcccttcggggatctctgccagcgactgccgcacccgcaccggctgcgccggtaaaaagacgtcgaaattatccagccgctgcacgcatttttcgtcaccctgccattgccagagcgtcgggttaacccggaagcgctgggcgcaggccacccgctcatcggcggcaagcggcgtcagacaaagcgcaaaatcaaagctcagcagtcccggcagttccgcttccggcgtcgccagccgctgacccgaggcacgacccggccgccacagcaaatcatctttgcccagctgcgatgccccgcgaaaaagcgttacgcgcagcaggcgctcctcgtattcatactctttcaggccgcgggcgaaaaaatggaaatcgtcgtgggcgcgcagctgatgcataaaaggctcgatgtccaccggccgctcggtgaaatctgtccgcgcactgtccggctggttctgccgggtgatccagccgaagggcatatccgcctgcaccgcggcgatgggcgtgccggtgtcgaaaaccagctgcatccggtgctcacgcacctgattatccaccgtcaggtgaaaacggatcagcgcctcttccagcgtcacggtcagcgtcaccgccacggacttcagatgcccgctgcgcccggtgcgctgcgcattcaggcactccggcagcgacagcaggctggcgacgatcatctcctgtttcgccggatgctgcttcaccgaaaccagttccatccagccggaacgtaactccacgtcccccgccagcggcgagaagtcatacagatcgccgtcgttacccagatcgctcagctggatcagccgcgtcagcgtgcacgggcggcgcttatccaccaggcacagattctgatcctgccagctgatgcggtagtgggcgttctcgataaaggtctggcgcagggactgcatccacggcatcgccgcaggttcattgtgctgcacaaaaaacagcgccatccccagcggcggcacaggcgcatggagaatgtccacccggttgcggtagtaatagtccgccgaaaaggtctccacttcgccgtcgggcgtcagcagcaccgcccgcggtttgcggattttttcctgcgccagcaggatgaattccaccggcagaccctgttcatccaccagccggaacccaggcgtcggcgtgatcagcacctgattgtgtgcgcagagggtgggcgcgcccgtgccgttaaccagcagaaaacggtagtcccgatccgcagccaggtttgccagcagcagacgggcgtgcaggctgaacagcgcctcgccgatctgccgggcgtgggcgcagcgggccagcacgtcgcggttggtttcatcgctgttgcagccgcccatgctgtcgtgggcgtgggactccagcagcatgcgccaggctttttccagcatcgcttcgctgcaggccagcccgttcaaacgcgccagcgccagcagcggttcggtctgatggatcagctgcgtttccgcatcgtcgttcgcgcgtttaatgtcgtagcgcgaggagccaatggttttatgcactctggacaggtgaggacggcggaactccccctgccatacggcgaggtcttcctcgttcagcgccgcgaagtaatcctcatagctgctgacgataaattcatcctcgctgtgggcgttaagctccgcgataagcctcgcgaaatccccgtcgcagctgacctgatcgccgccaatgggacacagcagatggcggcagggagtgagctgtttaagccgggcgatgagcgggaaggtttctgtctcaacatgcgatagcgagaaattacgccagcggccgccgcgctccgggtgcgccagcgaatagccaaacggcatgatcgccgtggtgatggcgtcgccgttcgccgcctgccagcgcatttccgtcgcgcccatcacctcaggatcgtagccccggcgcagcaaaatatgccgcagcccgaaggccgctgtcagctgcggcaactgtgccgggctgccgaaggtatccggtaaatagagcacgtccatgcagccgcctgccgcgcgggcaagctcaatgccgatgcgcaggttgcggaacacggattcggtgctgatgctgaacagatccggctgcgtataccaggggccgatcagcaaccgacgctggcgcacctgcgccgtcgcccgttcggtcatctccggtttgagctgtaaataatccgccagcagggagctttgtccgtccaggtggtacaccagttgcggatgagtttctaaggcttcaatcgcctccgtgaaggccttcagggcgaacacctgggtgtcgagggtggtgaaataccactccctgtcccagtgggtatgggataccgcatgaataatacgcttgtcgttcattgactttccttgtcgctggccatttccagcaggtattcggcatgaatatcctcgccgtaccacatcgggaaattggtgccccagatattgttatacaggtgggcgaaaatgccttccggctcgtcatgcggctcgccaaaccacagaatgcgcggctcatgcagggcgaccagcggcgcgtcgagcggctgtaattgccagtcgggggtgaaaacgcgctcgacgccgtgcagattgcggttgccgttgcgcgccacctgctgccagtcgatggtctggccgattttgcggcactgactgcgggatttatcgataagcccgaattgcagccagatctcctccggcaggcggttcgcctgtttaccgataatggatacctgatagcgaatggcagggcgatctttaccaaaacgccagctgtgccgcactttttccggtagccgcagcaccatgcccgcctcgttttgcacaaaacgcgcctcgataaaaagctgatactcgtccggcgtctcctccacgcgcacctcatgcagccgcagcgtggcgcagcgggaagtcacgggcacggcggtcagctccagccccggtttggtaaagtcggctatcgcccagtcgcgggtggtggtcagattttgcagataatgtctggcaaaacgctgatagtcgtcatcgcttacctgccggtaaatcactctgcccagtggcgtggcagagaacaccttaccgccgacgctcagggtgctgaggctgccatcatcggcgatataaagatgataatcgccgaaagtgcgtgaacgtcggttgacgataatgccctccatggcgacgggggcgaggggggtaaatttctctgttattgcaggcggcagacaggcgagagcgttatcaatgtaatcgcgctgctcctgccaggagacggcgatgttgtgatagccaggcgcacggcggtgcggcagacgcgcggcaaactcttcgataaagcggtacggctccgggatgccgttttccacacgatccgcctgccgcgccacgtcaaattcgccgggcaggtagtggttgtaatccgccagatgcagcttgagatccatcccccaggtgtgctccggcaccatgatcagctgcgccatcgcctgacgatacgcctcgctggcggcagagatccgcccggcggacacctcctctgccagcaatcgcaccagccgcagatagcggctgaccttgcccggatcggtcgccagtccgtgattccaggtgtcgccaatttcactgtcgattaccggtaattgatgtttgatggtttccacgcgggcagcaaacgcatccagcgtggaggcgctgacctcggcgtcgggataacgcgcctggtagcgggcgagagtggcataaacctgcgcggcgtcgggcggggcgcagttatcggcggcgtgacagaacaccagtaactcgtcgagcggctcgcaccagtattcgttgccatagcctcccggcgaatagttgacgataatttccgcctccccgagtcgccagcggaacagcggcggcacgtccggtgcggtggaggcttcattaacgccgaggtgtaaataagcgataccggcctcggccagccagggaatgatcgcctgggtatagccgggcacgtcggtcattttggcggcgatagtgcgcttattgaaacgcagatccagatccatcgcatagtcgagcccggattgcagggtgccggcgctgagcagttcgctgtgggaagtaaaaggcaggccatgccagacgatgtcgccgcgcaggatggcgtcagtcagcgctcgtcgcccctgatcgtctgccgtctgtaagaagcgggtgataagccaggccccgcaggtccagataaagtttttcgtccccggccggttcaccttctgcgccagctggatcaccgccgggataaactcatgcaggtatttatcttcgacggtgcgggccagatcggtaaagccaatatccagatgcgttttgtagatgatatgtacacgttgcacgggattatcctcgataaatagggttggtcagcaattgcgccaccgggccgcggttgatgcgcagcagggcgaaggccgcatcctgcacgtcaatttcctggttcacatcgccgtagcgattgggcaccacgatgacggtgttgtcggtgtagagcagcacgctgttgtctttatgggtgcggagtttgacgtgcaggatcccgccgctggtggtgtcgcccgggcctgcctcgccaatacagaagcggtgcaactgcgtctggtcatcgctttgcatatagctgcgcccggcgaccagcgcagagaggatgtcctggcgctcgcggctgatggcgcgtacccacatgtacggccagcgcagccctttttctttatgaaaatcgctgcccgccacggcgctgattttttcgccctggcagagctggtgatgccagtagttaaaagcgtcttcgttgccggtctgcccgtcccacggcccgttccagatctccagccagtcgtggtccgcaaaacggttctgccacgggcagtagtggcagaaagggtgattaataccgatgcgcgccccgttgcggcgggcttcggcaatgcgcccggcgatgtcatcttcggtaaaatgcggcagaaagttcaccaccggccgggtgacgcccagcaggttggcgtggccgcgctcgctggtcagctccatgccggggatcaggcacagtgaggcgttaatgcccgcgatttcatggttctgcgaaatggtgttgtgatcggaaaaacagaggaaatcgaactccatctggcgggcgcgggcaatcagttcgttcaccgttaagctgccgtcgctgtgcacagaatgcacatgcgtgtcgcctttcagccagcgcggaaatttcgggtacagggtgatctccaccaccacttcgcagaggcggcggatcttatgcagcccgagcagcacgtgccatttgccgttaacgatgctggtgcgctggtagccgggcgaggcgaaattttcgctcagcgtgatggttttacgcgcgccgccgctccagccgttgatgcggtcattgatcatcagccccatatccaccacgttacccggcgtgaagcggtagctgatgtcgatgcgctcggtattcagaccgggatcgaactccaggcggcgcagggttttttcctcatggggtgaaaccttcaggatacgggtcagtgtcaccggctcggtattcatgctgtttctccttcgtctaacagttccttgcagtcaccggcgatcatcaccacctcggcgccataaataatctggaaggcccgttcgctgacctgcacatagcctttcgcccgcagcgttttcttccacaccgcttcaggggcgacgcgggagccgtctttcacctgaacccgcaggcgtgaaatgcagttgtcgaactgctcgatattctctttgccgccgaaagcctcgatgatgtgccgggcgaagcgcattccctgttgctcgttaaaatcctgtttgctgtaaagccgggtagttgcctcatcctcttcgcgccccggcgtcatgacgttgaagcgcaggatcaaaaagcgaaacagcgcgtagtagagaacaaaaaacagcggtaccagccacagatagccccataaattgagtttcgcgggctggagcagtaccggcaggatgtctttcaggctgccgccgtagatcgacacgtttgccatttcggtaagcacaaaggcgaggccagtcagcggcacatgcaccagataaaacagccagggagcgacaaacagaaaggtgtattcgatgggttcggtgacgccaaacaggatcatggtggccaccaccgggatcagtaagcccgccacgacttttttatgcggcgatttcgcgcactggtagatggccagcgccgcccccggcagcgcgccgaaatgcaccaccacgcggccggactgaaagccgcgcaccagcagctgcggcgtcccctcgcaaccgagctgcgccatatagatattggtggtgccgcttaccagctggttgcagacggtcatggagccgcccagttccgtcagtcggatcggcgtggtgatcagatgatgcaggccgacgggcagcagggatttatccgccaccgcccagataaaggtgccgaacagaccggaattaccgataagcctgctgaactgcgccagcatgccgcccagcggcggccagataacataaagcagcacgccgagcagcgatccggccatcagcgtgacgataggtaccgtgcgcgtaccggcaaaaaaagagagtaccagcggcagtttgacgttatataagcggttatgcagcccggcggtgatcagccccaccgccataccgccgaatacgctcatgcggtaggagaacatccccagctcgctggtataaatcgaggcgcgctgtacggcggcaatgtcattcaaatgctgttgctgccggaaaaattcaacgctggtggtttgtggcgtaataccatttaattccagcagcgtggcgataataaaatgcatcgccataaaacagaccgcgccggaaaacgccgcccagcctttttcttttttcgccagaccgaaggccacgccaatggcgaagaacagcggcaggttgcgaaataccacgtcgccggtggccttcatcacgctgaaggtcgtaaataaaagcgagcctttggtaatgatgttctgtaaatgcagcgcttcgatggtgccgctactggtgaaggcgctgccaaagcccataaacattgagccgacggtaatgatggagattggcaccagcatcgcctggccaatcatttgcattgtttgcttcataaaaatccttttttacgggctttaattattcatttgaataatgtattgaagcactccggtttatttgttttgtgtgatattgactgcgataattactattccgctattttctttcttctcctgaaaataattatttattatcaggctgacgagcgcgaatataacgatttaacggggcgggttttgtgatgtgaacagcgtaacgctatcaatgcagaggatatttgtaagcaaaagatgccgcggttcacggcattattagcggtttcgttatcaggaaagggatggcgcgggcagaccatcgacgctgatttgcccgtcagccaggcgaataacgcggggaaagtggcggcgggtaaaatcatcatcatggctgatggcgagcaacgtcgtctgccgctggcgacagaccgccagccacgcttcaaagcgtgctaaccagcatgcgtcaaaatcccggctcggctcatccagcagcagcaccggcggggccatcgcctccaggcttgcgaccgccaccattcgccgttgggcagcatgcagatccagcggatgcgcctgcgccacgtccgccaggccgcacagctcaagcgccgcgcggacgcgctgctcaataacggtggtgggcaatttttgcagcttcaggccaaaagccacttcactcagcaccgtgctgtgcaggatctggttttccgcctcctgaaacagcacgccgatctgcgcggcgcgttgcggggcgttcagcgctgacagcggctgccctttcagtaaaacttcaccctgctgcggggtcagcagacccgccatcaggcgcagcagcgtggattttccggcgccattatcgccggttaacgccacccattcgccgcgctcaatgttcagcgtgaggtgatgcagacagttttccgcggccgcgggccagcggaaggtaaggttatgcaaagcgatcatagagcggtcagtcctgtttcatcgagctgccacatctggcggcaaaacgcctgcgctggctggcggtgacgttcaaagagcatcaccagcgccccgctggcatctgcccatgccgccaggcggctaagcatctgttgcgtggcctgcggcgtcagacggctgaaggcctcgtcgagcagcagcaggcgcggctgcatcgccagcgcacaggcgatcaccacccgctgggcttcgccgccggagagcgtggcggggtgccggtgacgcagcggcaggcaatcggtgagcgtcagtgcggcttcaagccgggcgaggatctcaccttccgccaggcacaggttttccggcccgaaggcaacttcttcttccacgctgaaggtacagccggagagttgcagggcaggggactgctgcaccagctgtacggtctgcgcctgttcgggctgcgaccgttcacccggcggctggcccaggatccgcccggttccgctaagggtgccgggcagataatccggataccatcccgcaagcagctgcgcgagggtgcttttgccgctgccattaccgccgaggatcgccaccatgcccggctgtgcgatctgcaaattcaggctacgcggcggcgcggcgctgtgcgtgggctgaaagcagaggttttctagcgtaaccatagccaggctccggtttctgccagcatcagcgcgagcagggtataacgcagcgcgcgctggcggcggctgtcggggggcgcccataaagtcgtgcgcgtgcggtgcagacgaaaggcgcgcatgtccagcgctgcgccgcgtaccggcagatcgttaagcgcgccctggatcagcggtacgatcagcgccgggacggcacgcagccgctgataccagcgcccgtccagcgggacgcctcgtgcgcgctgcgcttcgtgaatgctcgccagccggtgtttaagctgctcggcaatcagcagcggcccggagaacagatacgccacgcccggcggcagccggctggcaaaaagcgcgcggataaactgacgtaccggcacgaaagccatccacagttgcgacgtggcgacgatggtcagaatgcgctgccacaggatgatcgcctgcgcccagtggctggcatcgcgcggctcaccgctcagccaggccaccagccagccgccgtgcaccagccacatgccgacgccgagcgacgccatcagccaggccacatagcgggcgcggggacgggtagcgcggaacagcagcaggctgatgaaagccgcgccgcttaccaccgtcagcagcggcccggcgggcagcagcagcgccgaccaggcccccagactccacagcgtcagggaggtaaaaggatgcattcagcgtacggccgacatggtcgggaaacggcgcgtggtgcgcagcggcaactgacgcagcaggatccagacgatcgccgccgtgaggatcttatccaccagattcgcgcccaccaccgtcagcgccacggattcgatcagatcgttccccatggatcgcgcccaggcgacaaccagatccgcgccgctgccggtgacgccgccaaacagcgcggtgcggatcggcaccgccactatcgtgaccgccagggtgatcaggatcccgctgaccaccacctttggcagggtgcggaaccagccgagccgcgccagccagcctgccgtcagacctatcaccatcgccacaggtgcaaaggcggcggcaataggatcggttaacaatccccacagcaggttagtgagtaaaccggtcagcatgccgacaaccggccccagcaggacggcgctcagcagcgtgccgatagaatcaagaaaaattggcagcctgagcatactgataagctgcccgccgatcatattgatggcgacggaaataacgatcagaaccagcgtctggctggagagtgggcgacgcgccatagcaacctctttgatttaagcgacagttaacgggaatggacaacgagttcgtcatagccggagagcgggcagggctggcgcgaaaacgacagcgccgtcagttcgccaatcaccagttccagggtggtgcgcaccgtgcagccggacataacgtgaccgcccagcagcgcgccctgttcgtcggcaatgctcaggtgcagatgctcccccgttaattccagcgtgccggacagcgagatgagttcgtaggtgccggtaagccgggtgctttcatcgcggcccgcatagcgcagggcgacctccgtcaggctgccggtagcgccggcaatccatgcggcctgtagcccgtgaagggccataaactgacgtaattccgttaacagctcctgaccgggagcgaggcgcagcgcgtaaaaccgcgccgcagaggcaatggactgattcatgggatgagtaaactccgaaactcggacgtgggccgaatattaagagtgacggcggttctgtgtactgatgtatatcattaaaatattccgccgttatgacgcttttattctttagaaatgcccgttacgggaaaggatggccgcaacgtgagggggtaaaagtgtgatgcagatcagattactgtcgttcatcgccgggcgtcgattccttttattccgcgtttcgcttattctagctgaagcgtttcagtcgattaaattttcgacaaaatattaacaggtcgcagtttgcgacaggtaaggtttcccttgttgtgccgctgcattattctgtcagccacagcaaatcagggacagccttgcaggagatctatgaccgtacgcgtggcgataaatggcttcggtcgcatcgggcgtaacgtggttcgtgctttatatgaatccgggcgtcgtgcggaagtgagcgtggtggcaatcaatgaactggcggatgctgcgggcatggcgcatttgttgaaatatgacaccacccacgggcgtttcgcatgggatgtccgtcaggaacgcgaactgctgtatatcggcgatgacgccgtccgcctgctgcatcaggaaaccattgaggcgctgccctggcgtgagctgggcgtggatgtggtgctcgactgcaccggcgtgtacggcaatcgccagcacggcgaagcgcatctggcggcaggcgctaaaaaggtgctgttttcgcatcccggcagccacgatctcgacgccaccgtggtctttggcgtaaatcagcataccttgcgtgaagatgaccgcattgtatctaacgcctcctgcaccactaactgcattattccggtgatcaaacttcttgatgacgcttacggcattgattccggcacggtaacgacaatccattcggcgatgaacgatcagccggtgatcgacgcctggcacgcggatctgcgccgcacgcgcgccgccagccagtccatcatcccggtcgataccaaactcgcggcgggcatcacccgtttcttcccgcagtttgaagataaattcgaagccatttccgtgcgtgtgccgacgataaacgtcaccgcaatcgacttaagcgtcacggtgaagcaaccggtaaaagccatagaagtcaacctgttgctgcaaaaagcggcacagggtgcatttcatggtatagttgactatacggaattaccgttggtctcagcagattttaaccacgatccgcacagtgccattgtggatggtacgcagacgcgggtcagtggggcgcacctcatcaaaacgctggtgtggtgtgataatgaatggggctttgctaaccgaatgctcgacacgacgttagccatggcagcgactggtttcaggtgagatgcacattgcatctgccaaactttaaaaaaaacgagaggattcaccatgtctgtaattaagatgaccgatctggatctggctggtaaacgtgtttttatccgtgcggatctgaacgtaccggttaaagatggcaaagtcaccagcgacgcgcgtatccgtgcttctctgccgacgattgagctggcgctgaaacagggtgcgaaagtgatggttacttctcacctgggccgtcctaccgaaggcgagtacaacgaagaattctctctgctgccggtagttaactacctgaaagacaaactgtccagcccggttcgcctggtaaaagactacctggacggcgttgaagttgccgcaggcgagctggtagtgctggaaaacgttcgctttaacaaaggcgaaaagaaagacgacgaaaccctgtctaaaaaatacgccgcgctgtgcgacgtattcgtgatggacgccttcggcaccgcacaccgtgcgcaggcttccacccacggcatcgcgaaattcgcggacgtggcgtgcgcaggtccgctgctggcggaagagctggacgcgctgggtaaagcgctgaaagaaccggctcgcccgatggtagctatcgtcggtggttctaaagtctccaccaaactgaccgttctggattccctatccaaaatcgctgaccagctgatcgttggcggcggtattgcgaacaccttcgtcgccgctcagggtaataacgtaggtaaatccctgtacgaaccagacctggttgacgaagcaaaacgtctgctgaccacctgtgacatcccggttccgacggatgttcgcgtggcgaccgagttctctgaaaccgcgaccgcgactctgaaatctgccagcgacatcaaagatgaagagcagatcctcgatatgggcgacgtttccgcacagaaactggctgaaatcctgaaaaacgccaaaactattctgtggaacggcccggtaggtgtgttcgagttcccgaacttccgtaaaggtaccgaaatcgtggcgcacgctatcgccgacagcgaagcgttttccatcgccggtggtggtgataccctggcagccatcgatatgttcggtatcgctgacaaaatttcctacatctccactggcggcggtgcgttcctcgaattcgtggaaggcaaagtgctgcctgcagtagctatgctcgaagagcgcgctaagcagtaagtttgatcaggcggggaaacccgcctgattttcagcgcgctttactaaagcacgcgctccctttttctaacggccaagatacaggactacgtaacatgtctaaaattttcgatttcgtaaaacctggcgtgatcactggtgatgacgttcagaaagtgttccaggtagctaaagaaaacaacttcgctctgccggcagttaactgcgttggtaccgactccatcaacgccgttctggaaaccgctgcgaaagtgaaagcgccggtaatcgttcagttctctaacggtggcgcagccttcatcgctggtaaaggcgtgaagactgatattccgcagggcgcggcaatcctgggcgctatctctggcgcgcatcacgtacaccagatggctgagcactacggcgtgccggtgatcctgcacactgaccactgcgcgaagaaactgctgccgtggatcgacggtctgctggacgcgggtgaaaaacactttgcggcaaccggcaaaccgctgttctcttcccacatgatcgacctgtctgaagagtctctggaagagaacatcgaaatctgttccaaatacctggagcgcatgtccaaaatcggcatgaccctggaaatcgaactgggttgcaccggtggcgaagaagacggcgtggacaacagccacatggacgcttctgcactgtacacccagccggaagacgttgattacgcgtacaccaaactgaacgctatcagcccgcgcttcaccattgcggcgtccttcggtaacgtacacggcgtttacaagccgggtaacgtgaaactgactccgaccatcctgcgtgattctcaggaatacgtcagcaagaaacacaacctgccgcacaacgctctgaacttcgtgttccacggcggttccggttctactgcgcaggaaatcaaagactccgtaagctacggcgttatcaaaatgaacatcgataccgatacccagtgggcaacatgggaaggtatcctgaactactacaaagaaaacgaagcctatctgcagggccagctgggcaacccgaaaggcgaagaccagccgaacaagaaatactacgatccgcgcgtatggctgcgcgctgcacagacgtccatgatcacccgtctggagcaggctttcaaagaactgaacgcggttgacgttctgtaatctgaaataagctgggcaaatggcttcccccgggaagccatttttatttgcgggttattattccgctttaaaacattcatcacatttattcatccgctaattgtgagtcaaggcacataacctgccatgtgggataagtatgatcgttgtcgttgcgttgaaaataataatgaagctattgcaaacacaataaccataatgagtcgcgagggtattcaggcgaatatctccgtaaaacgtaaattacagcgcgctgtaatttatctctggttattgcgaggaaaggatgcacattcaacacgatctgcccgtcactattgacgatattttagacgctaaggaaaggctcgccggacatatctacaaaaccgggatgccacgctcaaattacctcagtgaatgctgccacggcgaaatctatttaaaatttgaaaatatgcagcgtaccggctcgtttaaaatacgcggtgcgttcaacaaactcagttcgcttaccgacgaggaacgtcagcgcggggtggtagcctgttccgccggtaatcatgcgcagggtgtctccctatcctgcgccatgcttggtatcaacggcaaagtggtgatgcccgtcagcgcgccgaaatcgaaagtcgccgccaccagcgattattccgcccaggtggtgatgcatggggagaattttaacgacaccatcgccaaagtcagtgaaattgtcgaaatggaaggacgtattttcattccgccttacaacgacgaaaaggtcatcgccgggcaggggacgatcggccttgagattttagaagatctctatgatgtcgataacgtcattttaccggtcggcggcggcggtttaattgccggggtcgcgctggctatcaaatcaattaacccaaccatcaatattatcggcgtgcaggcggaaaatgtgcacggtatgacggcctcgtttcgcgccgggaaaataaccagccatcgcaccacaggtacgctggcggacggctgcgacgtctcacgtcccggcgatttaacctttgagatcgtcaatgcattagtctcagatatgattctggtgagcgaagaagaaattcggcacagcatgttagcgctgatccagcgtaataagattatcgccgaaggggcaggggcgctggccaccgccgcattattaagcggcaagctcgacgatattatcaaaggccgaaaaaccgtcagccttatttccggcgggaatatcgatctctcgcgggtctccgctattaccggcgccggtgaattctgaaggtataaaaaggatattttatgagcacaactgacagcaccattctcagccagcaggacaaagcgctatggcgtaaatccgacaccacctggacgctgggattattcggcacggccattggcgcaggggtattattcttcccgatccgcgccggattcggcggcttgatccctattctctgtatgctgctgctggcgtacccgattgcctttttctgccaccgcgcgctggcccggctgtgcctgtccggcagcaaggtatcgggcaatattaccgaaacggtggaagagcacttcggcaggaccggcggcgtggtgatcacctttctctacttcttcgccatctgcccgctgctgtggatttacggcgttaccattaccaacacctttatgaccttctgggaaaatcagctccagctgatgccgctaaaccgtggcctggtggcgctggcgctgctgctgttaatggcggtggtgatctgcttcggtaaggatctgatggtcagggtgatgagctggctggtatttccgtttatcgcaagcctggtactgatctccctgtcgctgatcccctactggaacagcgcggtgtttgaccaggttaacctgagcgagatttcgctggccggtcatgacggtattctggtgacggtgtggctcggtatctccattatggtgttctcctttaacttctcgcccattgtctcctctttcgtggtctccaaacgcgaggagtatgaagcggattttggccgggattttactgaacgcaaatgtgcacaaattatctcccgcgccagcgtgctgatggtggcggtggtgatgtttttcgccttcagctgcctgtttaccctgtcgccgcaggatatggcggacgccaaagcgcaaaatattccggtgctctcttatctggcaaaccacttcgccgccatgagcggcagtaaatccacctttgccaccgtgctggagtatggcgcgtccattattgcgctggtggctatttttaaatccttctttggccattaccttggcaccctggaagggctgaacggcctggtagtcaagtttgcttacaaaggcgataaaacccgcgtctccaccggcaagctgaataccatcagcatgctgtttatcatgggttccacctggattgtggcctatgcgaatccgaatattctcgatctgatcgaagccatgggcgcgcctattatcgcttcgctgctgtgtttattgccgatgtatgccgtgcgcaaagtcccgcagcttgcgaaatatcagggcaaagccgacaacctgttcgttaccctgatcggcctgctgaccattctcaacatcctctacaaactattttgatcggctaaaaatgccacgacggagagggaaacctctccgttaatccgttgaaatctggcagatgatcttttttatggttaccctttgttgacctgtctcacgcctgcaacgtgagtgttacgccgttttggcaagaaaaaaaggaaccgtaaatggacgatcttaacgtggttggcagcatcaatagcgcagggggatggctggtacataaccaggcattactgctgagttatgcggtgaatatcgtggcggctatcgccattatcatcatcgggatgatcatcgcgcgtatcatttccaacggcctcaatcgcctgatgctggcgcgacatattgacgccaccgtggcggactttttatcggcgctggtgcgctatggcattatcgcctttacgctgattgccgcgctggggcgtgtcggggtgcaaaccgcctcggtgatcgccgtgctgggcgccgccggtctggccgttggtctggcattacaggggtcgctgtcgaacctggccgcgggcgtgctgctggtaaccttccgcccgttccgctccggcgaatatgttgatttgggcggtgtggccggtaccgtgctgcatgtgcagattttctctaccacgctgcgctctgccgatggccgctatgtggtgatcccgaacggtaaaatcatcgccgggaatatcatcaacttttcccgtgagccggtacgccgcaacgaatttatcatcggcgtggattacgacgcggatatcgatctggtgagaaaactgctgacggagatcatcgaatcggacgaccgcattcttaaagatcgcgagatgaccgttcgcatgaacgagctgggcgcctcaagcgtgaactttgtgatccgcgtctggagcaacagcggcgatctgcaaaacgtttactgggacgtgctggaacgcatcaagaaaaccttcgatgccaacggcattaacttcccgtatccgcagatggatgtgcatctgaaacgcgaaaaagcggaaaagcaggcggaagcggaagcctgacctgagcatcaatgcccggctacgttgccgggcggcgacttcgtcctgcccggcctacaggtggtaccctggccgggcagggtattattaactccacttatccccgattaaaataatccatttccgctaataactgccgcccggtatagtcggcgcattccttattagcgtgagtaattccaggtgttaacttattatattcaggggcttgccctcggcgcggctatgattttacccctcggcccgcaaaatgcgtttgtcatgaatcagggcattcgccgccaccatcatttgctggtcgcctcgctgtgcgcggtgagcgatttgctgctgatttgtgccgggatctttggcggcagcgcattgctgatgcagtcgccgtggctgctggccatcgtcacctggggcggcgtggcgttcttgctgtggtacggctttggcgcgctgaaaacggcgctcggcagccagccagagcttgccagtggggaagtatcaaaacagggccgcgggcggatcatcgccaccatgctggcggtcacctggcttaatccccatgtctatctcgataccttcgtggtgctcggcagcctgggcgggcaactggccgaaatgccgaaacgctggtttgcgctcggcaccatcagcgcctccttcctgtggtttttcagcctggcgctgctggcggcctggctcgccccgcgtctgcgtaccgccactgcccagcgcattattaatacgctggtgggtggtgtgatgtggttcattgcctttcagctggcccgcgaaggtgtccatcacttacaggcgctgtggtaatcagaccataccttatggacaagcgtgctgaaaacgctaagcttgctggcagaagcctgtatttttgggcgattgtcatgacatggaggaactacagtgaagtttaacgttatagccctggcagcaatggttggattaggtgcgatgtcggtacaggcaagcgaattgccgaacgggccgcacatcgttacttcaggcacggcgagcgtcgatgcggttccggatattgccaccctggcaattgaggtcaacgtagcggccaaggatgccgcctctgccaagaaacaggcagacgatcgcgtggcgcagtatttaggcttcctcgagaaaaacggcgttgccaaaaaagacatcaactccgccaacctgcgcactcagccggattacgactatcaggacggcaaaagcattctgaaaggctaccgcgcggtacgcagcgtggaagtgaccctgcacgagctggataaacttaactccctgctggatggcgcgctgaaagcgggcctgaacgaagtacgttcagtcaccctgggcgtggcgcagccggaagagtacaaagacaaagcgcgtaaagcggccattgacgatgcgaagcatcaggctgaacagctggcggcaggctttaacagcaagctcggccaggtgtacagcgtgcgctaccacgtttccaactatcagccgaccccgatggtccgcatgatgaaagcggatgccgccccggtatcagcccaggaaacctacgagcagccgaccattcagtttgacgatcaggtcgacgtggtgtttgaactgcaaccgggcgcaaacgcggcaccggcacagtccacgccagccagccagccggctccggcagcgcagtaaggttggtggtgtgcccggcggcgctgcgcttgccgggcctacgacagtacgacagtaggccgggtaagcgccagcgccacccggcagttgcgccacaatactttaatcctgacgcaatacccgatgaccgtgcgctaacagcgcatcggtgacgttgcgcatcatgcggctttccggcgcaaagcggtgccagtagagcatccggcgctggaacaggcccggcgtgagatcaatcagctcaccgctgtctaactctctttcaatctgcaaatgcgggatcatgcaacaggtggtgccctgacgcgccagctgcacgaaggcttctgacgagttcacgatatggcagggcacgctgcccggcggcaggtcgaaattctgctgtaaaaacgcctgatgcatatcatccagatggtcgaacgccacggcaggcgctttcagcaaggcctggcgggttacgccgttcggaaaatagcgctcagcaaaggctttcgagccgacaaacaggtaatcgagcgcacccagttggtccaccaggcagcttggcaatgcctgcggttgaatggagaccgcgcccaccacttcgccacgtcgcagccgctcctgggtgcgggtttcatcttccacctgtaaattcaggcggatcggcgaatcggccagcaccggggccagcgccggtagcaaccaggtcgccagactgtcggcgttgaccgccagcgacagcagcaacggcgtggaaccgatctgctcatccccgagccactcctcttccagcagttctacctgacgcagcaacgccagcagtttttgcccctgttcggtcgggcgcggcggcacggtacgcaccagcagcggctgaccaaacatgttctcaagctgtttaatgcgctgagaaacggcggactgagtgatacacagcttttgcgcggcgcgctcgaagccacgctcccggatgaccgcgtcaagcgcctgtaatgttctgtagtcaggacgtttcattgctataacttatccccgtttgtgattaggcgcactatgacataattttgtcgtcctggcgggatgcatttataatgcgggcaggattttctcaccacaggccaatgatcatgacgcaggatgaactgaaaaaagcagttggatgggcggcgctcaaatacgttgaacccggcactatcgtgggtgtgggcaccggctccacggcggcgcattttattgacgcgcttggcaccatgaaaggccagatcgaaggcgcggtatccagctccgatgcctccaccgccaaactgcaaagtctcggcattcacgtttttgatctcaacgaagtggaccgtctgggcgtgtacgttgacggcgctgacgagatcaacggtcagatgcagatgatcaaaggcggtggcgcggccctgacccgcgagaaaattatcgcctcggtggccgacaaatttatctgcatcgccgatgcctccaaagaagtggcgatcctcggcgcattcccgctgccggttgaggtgatcccgatggcgcgcagcgccgtggcgcgtgagctggtcaagctgggcggacgtccggaataccgtcagggcgtggtgaccgataacggcaacgtgatcctcgacgtgcacggcctggagatcatcgatcccatcgcgctggaaaacgccatcaacggcctgccgggtgtggtgacggtcgggctgttcgccaaccgtggcgcggatgtcgcgctgattggcaccgccgacggcgtgaaaaccatcgtaaaatgatctggcggggagcctgccttcccgttaaaaaaattttgcgtgacagattttggtgacatctatcacgttttttattccgctctgattttccttccgcaatcgttttcttttccagcattttcctctgccaaattccgctgtatgacttttcttcagagcgccgccgcaaaggttcatattgctgcaatagttttttttgatatgttggctaaggcgaacacacacataagttatgacaaacagggtcggggaaatggcaaaagtatcactggaaaaagacaaaattaagtttctgctggtggaaggggtgcatcaaaaagcaatcgatagcctccgcgccgcgggttacactaacatcgaattccacaaaggggcgctggacagcgaacagctgaaagcctccatccgtgatgcgcatttcatcggcctgcgatcccgtaccaacctgacggaagagattttcgcggcggcagaaaaacttgtcgccgtgggctgcttctgtatcggcaccaaccaggtggatctgaacgcggcggcaaaacgcggcattccggtgtttaacgcgcccttctcaaatacccgctcggtagcggagctggtgatcggcgagctgttgctgctgatgcgcggcattccggaagcgaacgccaaagcgcaccgcggtatctggaacaagctggcgaccggctcctatgaagcgcgcggcaaaaagctggggattatcggctacggccatatcggcacgcagctggggatcctcgcggaatcgctggggatgcacgtctttttctacgacattgaaagcaagctgccgctcggcaacgcgacccaggttcagcatctctccgacctgctgaacatgagcgacgtggtaagcctgcacgtaccggaaaacgcctccaccaaagatatgatgggcgcggaacagctggcgctgatgaaaccgggttcgctgctgatcaacgccgcacgcggcacggtggtggatattccggcattatgcgaagcgctgcgcagcaaacatctggcgggggcggcaatcgacgtcttcccgacggaaccggccaccaacagcgatccgttcaactctccgctgtgtgaattcgataacgtgctgttgacgccgcacatcggcggttccacccaggaagcgcaggaaaatatcggcctcgaagtggcgggcaaactggtgaaatactccgataacggctccacgctgtcggcggtgaacttcccggaagtatccctgccgctgcacggcggtcgtcgcctgctgcacatccatgaaaaccgtcctggcgtgctgaccgcgatcaaccagatttttgccgagcagggcgtgaacatcgccgcgcagtatctgcaaacctcgccgcaaatgggctatgtggtcattgatattgaagcggaagaggatgtggcagagaaagcgctgcacagcatgaaggccattccgggcaccatccgcgcccgactgctgtactgattttccctcacactgaccctctccccagggagaggggttaccacatccagactttcgacggcgtcaccaccgccggcagcggcacatcccactcttccaccggcagtttctccacaaactgacaatcatgggcgtaacccaccggcgtcagcgcgtactgttgccagttttgcagcgtgcggtcgtaaaagccacctcccatgcccagccgctgcccctgcgcgtcaaaggccaccagcggcgtgatcagcacatccagcttgctgagcggcagcacgtcgcgcacatccagcctcggctcataaattttcaaccggttcatcaccagatcgctttgcggatggtaatgcaaaaacagcagattgccggggctgaaagggtgcagtacgggcagatagacctgtttgccgctgcgccacagctgttcgataagcggacgggtatccagctcgccatcaaaggacaaaaacagcgcgacggtgcgggccatcaccacgggcggaaacgccatcatgcgggaggcggcctgttcggcaaagcgtaattgttgatcggtggtcaatgcgcgacggcgcagacgaatttgctggcgaatggtctgacggggtgaaaccgggagtgttgtttgcgtcatgataacggctggtacaggtagtggtagaagaaggggaatctccgagatgccgccgcaggctgtaacccttgaacccttggttcaaggtgaatgtgtcgtcacagttttaaggcttctcggacgaaccgagcatgctcaccaaccgtggagcgccacattcttgtggtatgaaatatcggctcaggggactggcccgcttgcgaacatctcagagaaattttttcttcatggtcactctaccatagtagaccctgaagtgttattcaaacttcggccccggtctttctgttatgcgaccctgatcaagcaatgcctgttcgatggtctgctgtaacatccgaatacgctgctccatgttggcggcgtagtcgcgggtttttgccttttcctgagcaagttcgtagctgatgttcaacgcggcgatgaaaaccagctgctcagtatttgtgactctagtgcgtactttcagatcttgcaaccgctgattcagatcttccgcagcctgattcaaagcatccctttgttcaggtgggcaattcactcgcagtgaacggccaaaaatttggatatcgacgggttctgcagacatgccaccttcctgctgtttgactgcgctctgccttcccagccgagccctggctgcgaaggggcgtcactatagctaccctgatgagaggattcaagccctttaacggcacaaatacattgcctgaggtaaggcctgacgggtatatcaccagggtccaaagtggtagcataccatgaatattcctcccaacgacgacgaatgcgcatgtcaatacagaacgaaatgcctggttacaatgaacttaaccagttactcaatcaacagggcgttggcttaaccgcggcggaaatgcacggtctgatcggcgggatgctctgcggcggcaacaaagacgcctcctggcagccgctgttgcacgacctgacaaacgaaggcctggcctttgggcatgagctggcggaagccttgcgcaagctgcatgccgccaccagcgacgcgctggaagacgatggtttccagttccagctgtttctgccggatggcgacgacaccacggttttcgaacgtgccgacgccatggcgggctgggtcaaccacttcctgcttggtctgggcgtcactcagccgaagctggataaagtgaccggcgaaaccggcgaggcgattgacgatctgcgcaacatcgcgcagctgggctacgaagaagacgaagatcaggaagagctggagatgtcgctggaagagatcgtcgagtatgtgcgcatcgccgcgctgctgtgccacgatacgttcacccgaccacagccaaccgcaccggaaatgcgtaagcccacgctacactaaactgtcttgttgaatatggaggtgtcatgacacagcttgaatttcttcgtcgccgtcaggccttactggcgcagatggcgcctgccagcgcggctctaatcttcgccgcgccggaagtgacccgcagcgccgacagtgaatatccctaccggcagagcagcgacttctggtatttcaccggctttaacgagccgcaggccgtgctggtgctgattaaaagcgatgacacccataaccacagcgtgctgtttaaccgcctgcgcgataaaaccgccgagatctggtttggccgccgtctcgggcaggaagccgccccggaaaaactgggcgtcgatcgcgcgctggcgttcagcgaaatcaacgagcaactctatcagttactgaacggcctcgacgtggtctatcacgcgcagggcgaatacgcctgggccgatgagatcgtctttgccgcgctggataaactgcgtaaaagcgcgcgccagaacctcaccgcgccagccaccatgaccgactggcgtccgatggtgcacgaaatgcgcctgttcaaatccgccgaagagatcgaggtgatgcgtcgcgccggagagatcaccgccctggcgcacacccgcgccatgcaggtctgccgtccggggatgttcgaataccagctggaaggcgaaattctgcacgaattttcccgccacggcgcgcgcttcccgtcctacaacaccatcgtcggcagcggtgaaaacgcctgcatcctgcactacaccgaaaacgaaagtgaaatgcgcgacggcgatctggtgctgattgacgctggatgcgaataccagggctacgcgggcgacattacccgtaccttcccggtaaacggcaaattcacccccgcccagcgcgccatctatgacatcgtgctggaatctttagagacggccctgcaacgcttccggccgggcgtctccattcaggacgtgactgccgacgtggtgcgcatcatgatcaccggcctggtgaagctcggcatcctgaaaggcgaaatcgaccagctgattgccgacaacgcgcaccgtccgttctttatgcatggcctgagccactggctggggctggatgtgcatgacgtcggcgtttacggcgcggatcgctcccgcgtgctggagccgggcatggtgatcaccgtcgagccgggtctgtacatcgccccggacgccgacgtgccggaagaataccgcggcattggcgtgcgtattgaagacgatattctgatcactgaagacggcaacgaaaacctcaccgccagcgtggttaaaaaagccgatgacatcgaggcgctgatggcggcagcgaaacgcgcatgagcgtgattatcgtgggcggcggcatggcgggcgcgaccctggcgctggccatttcacgcttatcaaagggaacgctgccggtgcatgtggtggaagccatcgccccggacgccacgcgccatccggggtttgatgcccgcgccattgcgctggcggagggcacctgtcagcagctggcgcgggtcggtatctggcaacgccttgccgactgcgctacacctattaccaccgtacacgtcagcgatcgcggccatgcgggttttgtcactttagaggcccaggattatcgcgtggacgcgctgggtcaggtggtcgagctgcatgatatcggccagcgcctttttgccatgctgaaaaacgcccccggcgtgacgctgcattgtcccgcacgggtcaataccttttcccgcacggaaaacggcgtcagcgtgatgctggaaaatggcgatcagatcgacggcacgctgctggtagccgcggatggctcccgttcgtcgctgggatcgcaaagcggcattacctggcagcagacgccctatcatcaggtggcggtgatcgccaacgtcacggtgtctgcgaaacaagctggccgcgccttcgagcgctttaccgagcatggcccgctggcactgctgccgatgacgcaggggcgctactcgctggtgtggtgccacgcagaaaacaagcgtgacgaggtgctcgcctggtctgacgaaaaattctgtcacgagctgcaaaaagccttcggctggcggctcgggcgtatccttcacgccggaacgcgcagcgcctatccgctgtcgctgaccaccgcctcgtcgtccatttcccatcgcgtggtgctggtgggcaatgccgcccagacgctgcatcctatcgccgggcaggggtttaacctcggcatgcgcgacgtgatgacgctggccgaaaccctgaccagcgcatgggcgagtcagacggacgtaggcatctatccggtgctgtgccagtatcaaaaacgccgccaggccgacaaagaggcgaccatcggcgtcaccgacgggctggtgcacctgttcgccaaccgctgggcaccgctggtcgccgggcgcaacgccggtctgatggcaatggaattatttaccccggcacgtgatgtgctggcgcagaggacgctgggctgggtcgcgcgctaggcctgtcttaccaggctattttatttgccattttgaacctgggcagtgctcaaaatcctcacgtactgcaagtacgctccggtttttccgcgctgtccgtgttcaaactggctgcaacaattacgcctgctaagccaggctgctggagtgaattgtgcaaagtgtagatgtagcaattgttggcgggggcatggtcgggctggctgtggcctgtggattacagggcagcgggctacgcgtggcggtgctggaacagaatgcgccggtgccgctggccccggatgcgccgcctgaactgcgcgtatccgccatcaacgccgccagtgaaaaactgctgacgcatctgggcgtctggtctgacattctggcgcaccgcgtcagctgctatcacggcatggaagtgtgggacaaagacagctttggccgcatcgcctttgacgacgaaagcatgggctacagccatctgggacacatcgtcgaaaacgccgtggtacatcaggcgctgtggcaaaaagcgcagcagagcagcgacatcacgttgattaccccggccacgctgcaacaggtcgcctggggcgaaaacgacgccttccttaccatgcaggacggcagcatgctgacggcgcggctggtggtgggcgctgacggcgctaactcctggctgcgtagcaaagccgatattccgctcacttactgggattacggccatcacgcgctggtggcgaccatccgtaccaccgagccgcacaacgccaccgcgcgtcaggtgttttacggcgacggcattctggcattcctgccgctggcggatccgcatctgtgctctattgtctggtcgttgccaccgcgtgaggcggaaaaaatgcagcaggccagcactgaagacttcaatcaggcgctgtgcgtggccttcgacaatgcccttggcctgtgtcaggtggagagcgagcgtcaggtttatccccttaccggacgctacgcccgtcagtttgccggccaccgtctggcgctggttggcgacgcggcgcacaccattcatccgctggccgggcagggcgtcaacctgggctttatggatgcggcagtgctggttaacgagctgcgtcgtctgcatcgcgagggcaaagacatcgggcagcatctctatctgcgccgttacgagcgcagccgcaagcacagcgcggcggtgatgctcgccgggatgcagggcttccgtgggctgtttgccggtaacaacccggcgaaaaaattgctgcgtgatattggtctcaagctggccgacaccctccctggcgtgaagccgcaacttatccgtcaggcgatgggtctcaacgaccttcccgactggctgaaataatcattttttagccttccgcctgaactaagatccgcgtcacactttcccttcccggttccgggaagggcagcgtcacctcatttgaaataatctaatttcacccgctttttcagattactttttctcatgtcatgaattttcagcgtcgggaaattctcatgatttttggtgaaaaatgtcactttacagggtcgggaagttcaattctccctataaagagaatgttaattactcgttattaagttttttacgctgtgcggctctgcgggttttcaggtcataagctaatgtgatggcgcatttttacttatggtttagggcgcttttcagtgataagttcaggcgaaaggtaacgtttgcgtcggcaacctgaaaggaggctgacgccgggggtcgtggcggtttttatgacccgggaaatccttaacagccccgcttattcaatgaggaaaagatggctcagcagactcctttgtttgaacaacacacgctatgtggcgcgcgcatggtggatttccacggctggatgatgccgctgcattacggctcccagcttgacgagcatcacgcggtacgccgcgatgcaggcatgttcgatgtgtcccacatgaccatcgtcgatctgaaaggcacccgtacccgcgacttcctgcgttacctgctggccaacgacgtagccagactcaccacccccggcaaggcgctctacagcggcatgcttaacgcctccggcggcgtgattgacgacctgatcgtctacttcttcagcgaagacttcttccgcctggtggtcaactccgccacccgcgaaaaagatctcgcctggatcaccgaacacgccgcgccttacgccatcgacatcagcgtgcgcgacgatctatcgctgatcgccgtgcagggcccgaacgccaaagccaaagccgccacgctgttcagcgatgaacaacgtgaagccgtcagcggcatgaagccattctttggcgtggaaacaggcggactctttattgccaccactggctacaccggcgaagcgggctatgaaatcgccatgccgaatgaaaaggccgccgaattctggcatgcgctggtggaagcgggcgtgaaaccctgcggcctgggcgcgcgcgatacgctgcgtctggaagcgggcatgaatctttacggtcaggaaatggatgaaggcgtctctccgctggccgccaatatgggctggaccatcgcctgggaacccgctgaccgcgactttattggccgcgacgcgctggaagcgcagcgtgaaaatggcaccgaacagctggtcggcctggtgatgaccgaaaaaggcgtgctgcgtaacgaactgccggtgcgtttcactgaccacgacggcaatcagcaggaaggcgttatcaccagcggtaccttctcaccgacgctgggctacagcattgcgctggcccgcgtaccggcaggcattggcgaaaccgccatcgtacagatccgtaaccgcgaaatgccggttaccgttaccaaacctgtttttgtgcgcatgggtaaacctgtcgcgtaacgcattttattgtggagaaacctttatgagcaatgtaccggctgaactgaaatacagtaaagaacatgaatggctgcgcaaagaagcggacggcagctacaccgttggcattaccgagcacgcgcaggagctgctgggtgatatggtgtttgtcgatctgcctgaagtgggcgcgaccgtcagcgcgggcgacgactgtgccgttgccgaatccgtaaaagccgcttccgatatttatgcgccggtcagcggcgagatcctggccgtcaacgacgcgctgagcgacacgccggagctggtcaacagcgagccgtacagcggcggctggatcttcaaaatcaaagccagcgatgaaagcgaagttgccgctctgctggacgccagcgcgtatgaagcgctgttagaagacgagtaaatatttcattactttgcaggcccggtgagcgccagcgccaccgggcaaatcagccagaccgtttcaggaaccctcgcccatgacacagacgctaagccagcttgaaaatagcggcgcattcattgaacgccacatcggaccggatgccacgcagcagcaggaaatgctgaacgccgtgggcgcagagtcccttaacgcgctgatcggccagattgtgccgaaagatattcagctggataccccgccgcaggtgggtgacgccgcaaccgaatttgccgcgctggcagagttaaaagccatcgccgcccgcaataaacgctttaagtcttatatcggcatgggttacaccgccgtgcagctgccgccggtgatcctgcgcaacatgctggaaaatccgggctggtataccgcttataccccgtatcagccggaagtttcccagggccgtctggaagcgctgcttaacttccagcaggtgaccctggatctgaccggactggacattgcctccgcctcgctgctcgatgaagccaccgcaggcgcggaagccatggcaatggcaaagcgcgtcagcaaactgaaaaacgccaaccgtttcttcgtggcggcagacgtacacccgcagacgctggacgtggtacgtacccgtgctgaaacctttggttttgacgtgatcgtcgatgatgctgacaaagtgctcgatcatcaggatgtgttcggcgtgctgttacagcaggtgggcaccaccggcgaagtgcatgactacagcgcgctgatcgccgaactgaaagcgcgcaaagtgattgtcagcgtagccgccgactttatggcgctggtgctgttaaccgcgccgggcaaacagggcgcggacatcgtcttcggctctgctcagcgtttcggcgtgcctatgggctacggcggcccgcacgcggccttcttcgctgcgaaagatgaattcaaacgttccatgccaggccgtattatcggcgtgtccaaagatgccgccggtaacaccgcgctgcgcatggcgatgcagacccgcgagcagcatatccgccgcgagaaagcgaactccaacatctgtacctcgcaggtgttgctggcgaacattgccagcctgtacgccgtgtatcacggtccggtcggcctgaagcgtattgccagtcgtattcaccgcctggcggatattctggcggcgggcctgcaacagcacggcctgaaactgcgccacgcccactacttcgacaccctgtgcgtggaagtggcggataaagccgaagtgctggcgcgtgctgaagcccgtgaaatcaacctgcgcagcgacatcattaacgcggtcggcattacgctggatgaaaccaccacccgcgaagacgtgcagctgttgcttgccgtgctcaccggcgttgagcagcacgacattgacgcgctggataaaaacgtcgctcacgacagccgttccattcagccggctatgctgcgcgaagacgcgatcctcgcgcatccggtgtttaaccgctatcacagcgaaaccgaaatgatgcgctacatgcacagtctggagcgcaaagatctggcccttaaccaggcgatgatcccgctcggctcctgcaccatgaagctgaacgccgcggccgaaatgatccccatcacctggccggaattctcggaactgcacccgttctgcccgccggagcaggcggaaggctatcaccagatgatcaaccagctctccgactggctggtcaaactcaccggttacgatgccttgtgtatgcagccgaactccggcgcgcagggcgaatatgccggtctgctggcgatccgtcactatcacgaaagccgtaacgaagggcatcgcgatatttgcctgatcccgagctccgcgcacggtactaacccggcgtcggcacagatggcggggatgcaggtcgtggttgtggcctgtgataaaaacggcaacatcgatctgaacgatttgcgcgccaaagcagagcaggcgggcgacaatctctcctgcattatggtgacctacccgtccacccacggcgtgtatgaagagaccatccgcgaagtctgcgagatcgtgcaccagttcggcggccaggtgtatctggatggcgcgaacatgaacgcccaggtgggcattacctcgccgggctttatcggcgcggatgtgtcgcaccttaacctgcataaaaccttctgcattccgcacggcggcggcggtcctggcatggggccgatcggcgtgaaagcgcatctggcaccttttgtaccgggacacagcgtggtgcaaatcgaagggatgctgacccgtcagggcgcggtatccgcggccccgttcggcagcgcctctattctgccgatcagctggatgtatatccgcatgatgggcgcggaagggctgaaaaaggcaagccaggtggcgatcctcaatgccaactacatcgccagccgtctgaaagacgcctatcctgtgttgtacaccggtcgcgacggtcgtgtggcgcacgaatgtattctggatattcgtccgctgaaagaagagaccggtatcagcgagctggacatcgccaagcgcctgatcgactacggtttccatgcgccgactatgtccttcccggtggcgggcacgctgatggttgagccgacagaatccgaaagcaaagtcgaactggaccgctttattgatgcgatgctggcgatccgtggggaaatcgaccgcgtgcaggccggtgagtggacgctggaagataacccgctggtcaacgcgccgcacacccagcgcgagctggtggcggagtggcagcacggttacagccgcgagcaggcggtcttcccggcagggctgaacaacaaatactggccgaccgtgaagcgtcttgacgacgtgtacggcgaccgcaatctgttctgctcctgcgtgccgatgagcgactatgagtaattgatccgttctgttctgtaggccgggtaagcgtcagcgccacccggctttttttatgaggaaaacgtaatggcaatagcactggttaccggcggcagccgcgggatcggcaaagcaacggcgctgcaactggcgcgcgagggttataccgtggcggtgaactatcaccacaatattcaggccgccaccgacgtggttaacgagatcgtcgcagcaggcggcaacgcctttgcgctgcgggcggacatcagcgatgaagcgcaggtgctggcgatgtttgagagtatcgatcgggaaggcgcgcctctgaccgcgctggtgaataacgcgggcattttgtttgaacagagcactatcgaaaacctgagtgccgaacgcatcaaccgcgtccttgcgaccaacgtcaccggctattttctttgctgtcgcgaggcggtaaaacgtatgtcccataagcacggcggggcaggcggtgctattgtcaacgtctcttccgccgcatcacgcctgggcgctgcgggtgagtatgtggattatgccgcctcgaaaggggcagtagatacgctgacgaccggcctggcgctggaagtggcggcgcaggggatccgcgtgaactgtgtacggccgggttttatctacacggagatgcatgccgacggcggcgagccggggcgcgtggatcgggtgaagacggtattaccaatgcagcgcggcggccagcccgaagaagtggcgcaggcgatagtctggctattgagtgaaaaggcgtcctatgtgacgggaagttttcttgagctggcgggcgggaaataaacaggccctgaacgcgtgtaggccgggtaagcgtcagcgccacccggcaaaatgaagccttgtaggccgggtaagcgcaagcgccacccggcaactgtcaacctcagagattctcgccgttgctggcgatcacttctttgtaccagttaaagctcttcttacgggaacgggacatgtcgccggtgccgtcgtcgtgcttattcacataaataaagccatagcgcttgctgtactgcccggtagtgaaggacacacagtcgatgcagccccacggggtatagcccatcagatccacaccgtcataagtcaccgctttgaccatctcttccacgtgcgcccgcagatagtcgatgcggtaatcgtcgttgatgctgccgtcttcttccactttgtcgtaagcgccaaagccgttttccacgatgaacagcggtttctggtaacgctcatagagttcgcacagcgcatagcgcaggccaaccgggtcaatctgccagccccagtcggaggccttcacgtgcgggttcggcacgctgccctggaaaccggagatcgcatcgccgctgccgccttcttctttcacggcgttggtcatgtagtagctgaagcccagataatcgcaggtgccttcacgcaggatctgctcatcgcccgcttccattttgatgttgaattcccggcgttcccactcgttcaggacataggatgggtagtagccgcgcagctgcacgtcggtaaagacataacgctcacgcatggattcctgggcatacattacatcttccggcttacaggagaacgggtacagcggcaccatcgccagcatacagccgattttcatctccggattaatgcgatgaccaatcttcaccgccatggcgctggctacgaactggtgatgcagcacctggtacatggtctcttccggattatcatgctcggtatagaccacgccggagcagcagtagccgaacagcggcgcgcgccagttacgctggttgttgatctcgttaaaggtcatccagtatttaactttgttcttatagcgctcgaataccacttccgagaaacgcacaaagaaatccaccactttacggttggtccagccgccgtattcctgcaccagatgcaatggcatttcaaagtgggagagggtgatcaccggctcaatgttgtatttgagcagctcatcaaacatgtcgtcgtaaaactgcaggccttcttcgttcggctcggcctcatcgcctttcgggaagatgcgtgtccaggcgatggaggtgcggaagcatttgaagcccatctcggcaaacagcttgatgtcttctttatagtggctgtaaaactccaccgcttcgtggttcgggtagtatttgcccggcaccacttcgctggtgatctcgcgcggtacgccgtgcgcgccgccggtcagcacgtcacaaatgctcgggcctttgccgcctttgttccagccgccttcaacctgatgcgccgcaaccgcgccgccccataaaaagtctttcggtaatgtcagctttttcatcgatcattttctcttgtgtgcagtaaataaaggttaccgggcagtttcactctgaaaatgagtctaacaaagggcggagaaatgtcacgatataacaaatcaccgctacggtgacttgttacatggaaaaaacagcctgtttttttatgctaatttcttcgccagtttacggcctaaggattcgagaatataaattaccgggatttgcgtggtgacatcataaaccccggcgatacgcatttgcggcgcatgccaggagatattgaaatccgccagtttcgccagccgcgaatgctcatggctggtgatggtcatcactttacagttatgcaggctgaactggctggcgaagcgcaggatctcttcagtttcaccggacaccgacagcacgatagccagcgcgtttttcgccatgtcgttagtcaccggaaaataaggatcgtcaatatggttgctgaattttccgatattggaaaagaatcgtgcgccatatttagcaagcgacccagaagtgcctgcgccgacaaaaataatacgctcggaagcgaaaataatatcaaccgcctgatccagaagcgtatcaaattcatcgttattcacgcttttaaaaaagctgataatttccccggcgccaaaattagcctgcggcggttcgttctgctctaaatataatttatagcgcacgcgaaattccgaatagccttcgcaattcagcttgcggcagaagcgcagtacggtggtggtggagacgccagcagcgtcggccagctcgcgaatggtcatgtacatcaccttgtcgcgattcttgatgacgtagtgataaaccatcatctcaagattattgaggctggcgacagcggagtgagtaaacagggtcacgggcttgcaggatcctttccgggcaactgaacggctctatgctgccacaaaacggacaaaacaggaatcgcataacgccgggtgcagtcaccgggaaaaatgaacaactgtaaacttaacaatgcccgcaatgcctggaagcgaagcggctggaaatatattttagcgaacaggtgtgcactggaatcattctcagttactctggtgaggtcatcgtcagtgtcgcgcgtttgtcatcatcgtgcgtcagaatggcgatgagtaacctttgtttcctggagtacgccaatggttgaaaaaccgcttatcacgaagggatattcagtggctgaggaagtagccaacagcatcagtcacggcatcgggctggtgtttgggatcgtcggcctggtactgctgctggtacaggcagttgataacaacgccagcgccaccgccatcaccagcttcagcgtttacggcagcagtatgattgtgctgtatctggcctccacgctgtaccacgccattccgcatccgcgggctaaagtctggttaaagaaatttgaccactgcgccatctatttattaatcgccggcacctataccccatttttactggtcgggctggattcaccgctggcgcgggggctgatgattgttatctggagcctggcgctgctggggatcctgtttaagctgaccattgcgcaccgctttgaggtgctgtcgctaattacctatctggcgatgggctggctgtcgctggtggtgatttatgaaatggtgatgaagctggccgttggcagcgtaacgctgctggccgtgggcggcctggtgtatacgctgggggtgatcttttacgcctgccagcgcattccgtataaccacgctatctggcacggctttgtactgggcggcagcgtctgccactttctggcaatttatttgtatatcggcacagtgtaattactgccggaaaggcaatgtatgcccggcaagcaacgcgccgccgggccaaccagcctggatcaggcttcttctaacgagtagggcagcggctcgatggccagcgtaaagctgtcatcgcgcacacggaacacgctgtccggctccatatcgttattcatcactacctgcaccagcaaacgcccgtcttccagctgagcggcggcgagcaccgtgccggttctgcgccagttttcacccagtttcatttccagatcttcaccggcttccggtacccggctggctttgcccgccagataccacattgcgcgcttattcgcgccgcggaatttcgcccgcgctaccatctcctggccggtatagcagccttttttaaagctgatgccgcccagcgcctgaatattggtagcctgcggcaggaactgcgcactgttggcggcatcgatcaccggcagaccggcctcaatgttcagcgccagccactgctgactgttattaagctgcgcttcgccgcgcagggtttcggtgatgcgctccgcggtggcgacatcggttaccagcaggaagcgctccgccggttgctcaaaccacagaatttgcgtgtcgccatcctgcaccacctgcgtttgctgatcgggcagggtggagaacaggttcgccagcgccgcgcgggcctggaatccggccacgccaagcagcacgtgttcgtcatcggcggcaatggtgaccttcgagaagacggcatattttttcagctcggtcagctgcgcctcgcggacgctgcgacgttcaacccacgcaaagccatcgttacgacggaacaggcgcaggttgctccacattttgcctttggcatcgcaatgggcaaccagcagatgctgatgttcagtgagttgcgccacgtcgttagtgacctggccctgcaaatatttttcgctgtcggcaccggtgatcgtggccagcgcccagtcatcgagcgtcattagcgtcagcggcaaacgcgcagaggcgcagggcagacgcggaggaaacggagtaaaagccataatgatgtcctggtaagcttaacgctgtatgaatgcttaatgttaaaagagccgtggttcattgcaagcggtaatcgcgtggaccgcacagcttgcgagtttgcgcgcaaaaaatggtaatccttacatttttaaaggtttattctggaagcttgcttctgaagccgaacattccggtgaggattggccggaaaaagcgttacactagaagccatctttaacgtcgctatgcaggaaaagaacatggatattaccaacaaagcccgcattcactgggcgtgccgcagaggtatgcgtgaactcgacatttccatcatgcctttcttcgaacacgagtacgatacgctaagcgatgacgacaagcggctgtttatccgcctgcttgagagcgacgatccggatttattcaactggctgatgaatcacggcgaacctgcagatacggaattgcagcggatggtccagttaattcagacacggaatcgggaacgtggtcctgtggcaatctgatttacgcgtctcatggcgctcgcaatggctctctttattactgcacggtctggtggcggcgctggtgttgcttatcccctggccgttaagttatacgccgttgtggttattactgctttcgctggtggtgtttgactgcgtgcgcagccagcgccgaattaacgccagccatggtgaaattaaactcctgatggattcgcgcctgcgctggcagggcaatgaatgggatattacaggcgcgccctggttgttaaacagcggcatgatgctgcgcttacggcgcagtacggacggcaaacggcagcatttgtggctggcggcggacagtatggacgcgcaggagtggcgggagctgcgccggatgatgctccagcaaccggcgcaggaaaagcactgaggctcaggcgaagttttccgccatttcgccaagaatttgctcgcaccaggtttgcaggcgttcttcgcttaaatcgtactgattggtttcatccagcgccaggccgacaaacagctgcccgtccgcaatgacgggtttggggctggtgaactcatagccttcggtgggccagtagccgataaacttcaccgctttggcggacagtttgtcgtgcagcatgccgagggcgtcaaggaaccattcgccgtaaccgagctgatcgcccatgccgtagagggcaatcattttgccatccaggttaagggaatccagctgatcccagatggcttcccagtcttcctgcagctcgccgaaatcccatgtcgggatgccgaggatcagcacatcgtactgctccatcagtgtgggcgcgtcgtctttaaggttatgcagcgtcaccagttccgggccgataatgtcgcggattttctctgctgccatttcggtatagcaggtactggaaccataaaaaagaccaatgttcatagcgtaaacgtctcaattcctgatgtggctttgcgcacagtgtaccagaatcaatacgcaatcaggcataatgccctgacgttgaaataaggggcaatgatggaacaggatctcgcacgcatagaacaatttctcgatgccctgtggctggaacgcaatgtggctgagaacacattgagcgcctatcgtcgcgatctgcgtatgcttgtcgagtggctgcaccacagaaacagcgatgtgctcagcgtgcagcatgacgatttacaggcgctgctggccgagcgcgtcaccggcggctacaaagcgaccagctccgcccgtttactgagcgcgatgcggcgttttttccagtatctttatcgcgaaaaggtacgtactgacgatcccagcgccgttctggcatcgccaaaactgccgcagcgcctgccaaaagatctgagcgaggcgcaggtcgagcgcctgttgcaggcgccgcttaccgatcagccgctggagttacgtgacaaagccatgctggaagtgttgtatgctaccggcctgcgcgtgtcggaactggtcgggctgacaatgagcgacatcagtttgcgtcagggcgtagtgcgggtgatcggtaaaggtaacaaagaacggctggtgccgctgggggaagaagcggtctactggctggaaaactacctggagcacgggcggccctggcttttaaacggcgcgtcagtggatgtgctgtttcccagtagtcgcgcccaacaaatgacccggcagacgttctggcatcgtattaagcattatgccatccaggcgggcatagacagtgaaaagctttcgccgcacgtgttgcgacatgccttcgccacgcatctgttaaaccatggcgctgatttgcgcgtcgtacagatgctgcttgggcacagcgatctctccaccacgcaaatttatacgcatgtggcgacagaacgtttgcggcaactccatcaacagcaccacccacgcgcgtgatgctgatttattaaggatgtgaaatgaaaaaaagtttgatgatgttcaccctgctggcggcgttcagtaccgcagttcaggccgacgatgcggccattaagcagacgctggcgaagctgggcgtgcagagcacggaaattcagccatcacccatcagcggtatgaaaaccgtgctgactaacagcggcgtgctgtacgtcactgaagacggcaaacatatgatccaggggccgctgtatgacgtgagcggtccgcagccgatcaacaccaccaacagcatgctgatgacgcatctcaacgcgctggaaaaagagatgatcgtgtataaagcggcgaacgaaaaacacgtcattaccgtattcaccgacatcacctgcggctactgccataagctgcacgagcagatggcggattacaacgcgctgggcattaccgtgcgttatctggcgttcccgcgtcagggtatgcagagcgaagcggcagacaatatgaaggccatctggtgcgccaaagatcgcaacaaagcctttgacgatgcgatggcgggcaaaggtgtgaaggccgcaagctgtgatgtcgacattgccgaccagtatgcccttggcgtgcagtttggcgtgagcggcacgccggcgattgtgctgagcaatggctatgtcgtgccgggctatcaggcccctcaggagatgaaaaccttcctggacgagcataaaaaacagaccggcggtaaataattttcgtgaaacttcagagacaacttcgccgccgcgagccggatccagcggcaaatctgccggataacctgccgcccctgttacgccgtctgtatgccagccgtggcgtggtatcgcctgcggagctggagcgcggcgtaaaagggatgctgccctggcagcaactgagcggcgtggagaaggcagcggagcatctgtatcaggcgtttaagcaggggctgcgcattatggtggtcggcgattttgatgccgatggcgctaccagcaccgcgctgagcgtactggcgatgcggtcgatgggctgtccgaacgtcgcctatctggtgccgaaccgctttgatgacggttatggtttaagcccggaagtggtcgaccaggcccatgcccgtggcgcgcagctgatcctcaccgtggataacggcatctcgtcccatgcgggcgtggagcgcgcccatgaactgggtattccagtgctggtgaccgatcaccatctgcccggcgagacgctgccagatgcagaagccatcgttaacccgaatctgcgcgactgcgccttcccgtcgaaatcgctggcgggcgtcggagtggccttttacctgatgctggcgctgcgcacccatctgcgcgatcagggctggtttgaggcgcaggggatagcgatccccaatctggccgagctgctggatctggtggcgctgggtacggtagccgacgtggtgcccctggataccaacaaccgtattcttacctggcagggcttaagccggatccgcgcgggcaggtgccgtcctggcatcaaagccctgctggaagtcgcgaatcgtgacgcgcaaaaacttgcagccagcgatctgggctttgctctcggtccgcgcctgaacgccgccggacgactggatgacatgtcggtcggcgtggcattgctgctgtgcgataacgttggcgaagcccgcgtgctggccagcgaactggatgcgttaaaccagacgcgcaaagagattgaacaggggatgcaggcggaagcgctggcgctgtgcgaaaagctggagcgcagcagcgaagcccttcccggcgggctggcaatgtatcaccccgaatggcatcagggcgtggtggggattctcgcctcccgcctgaaagagcgctttaaccgcccggtgatcgcctttgcccctgcgggtgagggcctgctgaaaggttcgggtcgctctatccaggggctgcatatgcgcgatgcgctggagcggcttgatacgctctatccgggcatgatgctcaaattcggcggccacgcgatggcggccgggctgtcgctggaagtggcgcgcttcgacgagttccagcagcgctttggcgcgctggtgaccgaatggctggatccggcgctgttacagggggaaatcgtttccgacggcccgctggacgcgcaggagatgacgcttggcgtcgccgaaatgctgcgtgatgccgggccctggggacagatgttcccggaaccgctgttcgatggacgttttcgcctgctgcagcagcgcatcgttggcgaacgccatctgaaagtgatggtggagccggtcggcggcggcccgctgctggacggcatcgcctttaacgtcgacaccagcatctggccggataacggcgtgcgggaagtgagcctcgcctataaactggatgtaaatgagtttcgcggcaatcgcagcgttcagctgattatcgacgacatctggccaatttagcgccagtattcgctataaaacagggcgtaattccggtagaattccgcccttataaccgcattttgacaagtccaataaaagaaaacagaccatgtttgaaatcaatccggtaaaaaaccgcattcaggacctcacggagcgctcggacgttcttagggggtatctttgactacgatgccaagaaagagcgtctggaagaagtaaacgccgagctggaacagtcggacgtctggaacgaacctgaacgcgcacaggcgctgggtaaagagcgttcctccctcgaagccatcgttgaaaccctggatcaaatgcgccagggtctggaagacgtcgctggcctgcttgagctggccgtggaagccgacgacgaagaaacctttaacgaagccgtggctgagctggacgggctggaagagaagctggcgcagcttgaattccgccgtatgttctccggtgaatacgacagcgccgactgctacctggatatccaggccggttccggcggcacagaagcccaggactgggcgagcatgctgacccgtatgtatctgcgctgggccgaagcccgcggcttcaaaaccgaaattatcgaagaatccgaaggtgaagtggcgggtcttaaatccgtgaccatcaagatttccggcgattacgcttacggctggctgcgtaccgaaaccggcgttcaccgcctggtgcgtaagagcccgttcgactccggcggccgtcgccatacgtcgttcagctccgcgttcgtttacccggaagtggatgacgatattgatattgaaatcaacccggcggacctgcgtatcgacgtttaccgtgcctccggtgcgggcggtcagcacgttaaccgtacggaatcggcggtgcgtattacgcacatcccgaccaataccgtcacgcagtgccagaacgaccgctctcagcataagaacaaagaccaggccatgaagcagatgaaagcgaagctttatgaactggaaatgcagaagaaaaacgctgagaaacaggcgatggaagacaacaagtccgacatcggctggggcagccagatccgttcttatgtgctggacgactcccgcatcaaagacctgcgtaccggtgttgaaacccgtaacacgcaggcggtgctggatggcagtctggaccaatttattgaagcaagtttgaaagcagggctatgaggaaccaacatgtctgaacaacaagcacagggcgctgaaaccgtagttgatctgaacaatgaactgaaagctcgccgcgaaaagctggcacaactgcgtgagcagggtgttgcgttcccgaacgatttccgtcgcgatcatacctctgaccagctgcatgccgcctacgacgacaaagataacgaagagctggaatcgctcggtatcgaagtcgccgtggctggccgtatgatgacccgccgcgtaatgggtaaagcctcgttcgtcaccctgcaggacgttggcggtcgcatccagctgtacgtctcccgtgacgatctggctgaaggcgtctataacgagcagttcaaaaagtgggatctcggtgacatcctcggcgcgcgcggcaagctgttcaggacaaaaaccggcgagctgtccattcactgcaccgagctgcgtctgctgaccaaagccctgcgcccgctgccggacaaattccacggcctgcaggaccaggaagcgcgctatcgtcagcgctacctggatctcatcgctaacgaagaatcccgcaacacctttaaaattcgctcgcagatcatggccggtattcgccagttcatggtaagccgcgactttatggaagtggaaaccccgatgatgcaggtcatccctggcggcgcgtctgcgcgtccgtttgtgacccatcacaatgcgctggatctggacatgtacctgcgtatcgcgccggaactgtacctcaagcgtctggtggtcggcggcttcgatcgcgtgtttgaaatcaaccgtaacttccgtaacgaaggcatctccgtacgtcacaatccagagttcaccatgatggaactctatatggcgtatgcggattacaaagatctgatcgagctgaccgagtccctgttccgcaccctggcgcaggatattctgggcagcaccaaagtgccgtacgacgaccaggtctttgacttcggtaaaccgttcgaaaaactgaccatgcgcgaagcgatcaagaaataccgtccggaaacggatctggcagatctggataacttcgacagcgcgaaagccatcgccgaaagcctgggcatcaaagttgagaagagctggggtctgggccgcatcgtgaccgagatcttcgaagagaccgccgaagcgcatctgatccagccgaccttcattactgaatacccggcagaagtgtctccgctggcgcgtcgtaacgatgaaaacccggagatcaccgaccgctttgagttcttcatcggcggacgtgaaatcggtaacggctttagcgagctgaacgatgcgcaggatcaggctaaacgcttccaggatcaggttgacgcgaaagcggcgggcgacgacgaagccatgttcttcgacgaagactacgtcaccgcgctggagcacggtctgccgccgactgcgggtctgggcattggtatcgaccgtatggtgatgctgttcaccaaccgtcataccatccgcgacgtgatcctcttcccggctatgcgtccggttaaataatcacgcgcaacgcgaacaagccctggcagcgatgccggggctttttttatgcggcggcgaaaacgcgcagccgttcccgcacctcgggccgggcgacctgctgcaccatccacgggctgaacgcccagggtgtggcatccacggcgcagaacagcgcttccagtgttacccactgatgatccatcacttcatcggcattcaccgccagcggcgtggtaacgcgcgcggcaaacaccgggcaaatttcattttcgacaatgcctgaaggatcggtttcgcagtagcggaattccggatacaccggcgcaatggcggcgacggtcgcgccgacttcaaactgacagcgacggatcaccgcggcggtaaaatcttccccgctttgcggatgcccgcatacggagttggtccatacgcccggccaggcttttttgtgcagggagcggcgggtaagcaggcactcgccgcgtgcattgaacagccaactggagaaggcgagatgcaggggcgtatcggcatggtgggcggcatatttttcctgcgtcccggccgccatgccctgctcatccagtaaaatcacatgttcctgcaacataatctttatccactctcaatccagccagaataacggctctattatacgtgagggtcaataaaacgttttgctctggcgcgcttaatctggcatgaccagcgacatttattcagtgaactgggtaatagacgctaatgcattttgcatcgcggctgtggctgctatgatatgcagtcatgctcatttgttccggggaagtgttttgattgcaggacgcctgatgaaaaatccgtgtcgacttcttatctgcctggcgttcagcctgttgctggcggcatgctcatcgaaaaacgccgccgacggcgagacttacaccgttaagcgtggcgacaccttatctaaaatttcgcgcatgaccggcaccagcgtcaaagagctggcgcgcctgaacgggatttccccgccttacactattgaaatcggccagcgtctgcgggttaacagcggcggcaaatccggcggctcgggtaagggcggcaaaaccgcgtccgccagaccgtcagcttccgtgcccttagcctcctggccgccggtgggtcaacgctgctggcgctggccgacgaacggtaaaattatcctgccgtactcctccgccgatggcggtaacaaggggctggatattgccggtacgcgcggacagccggtgtacgccgccggtgccggtaaagtggtgtacgtcggcaaccagctgcgcggttacggcaatctgattatgatcaagcacagcgaagactatattacggcctatgcccataatgattcgctgctggtgaataacggccagagcgtgaagatcggtcagaagattgccactatgggcagcaccgacgccgactcggtgcgattgcacttccagctgcgttatcgcgccacggcaatcgatccggcgcgttatctgccgccgcagggcagtccgcctaaatgctaagcgattaatatatcgccggttagccgccatgcggcttgccagacggtgcgtaaggtttataatgccctacgcacctcaaagcgggcgtagttcaatggtagaacgagagcttcccaagctctatacgagggttcgattcccttcgcccgctccagatttattctttcatcaccccaggctgcaccctcaactgattctctccgacctttttcccgtgcctgtcttcgatccagtaattgatctccacgtcctgtttatccgcaggcgttaccgtcacctcctgcactttttgtccggaatcagcaggaatagtcagggtggtttcacccttatccagcacgcgccgatcctgcttcacctgccatttcagctggcactgatcgcaggcagaccaggtatcgttgatcgcccacagccgcacggtggcgggctggccgggctgccaccgggcggtgacaggttcaatggacggcagcagcggctgataggctttttgcagcgcgtaatagcctgctttcggtttgcgcagatagtccaccacgccccagttgatggaaggccaggtctcgacaaacataaaatggaacagcgcggttaccggctggtaacgctgtcggcgatagctttctgccgccgtggcgaccagttccgcctgataggcctgcgtattggcgatcatctgctgcaaattatcgccgcgcgggattttggcgaacttaaaggtctggaaaggctggaagttgtggtatttccagcgcgtccagccaggatcgtcggcggcggtggttttcggccagcgcacttctggcggaataatggtcttcagggtcgacagccgcggcagcgcctgcgcgccgaattcagtaataatggcggttttggccgggccaagcagatcgcggatggtgccgaaataccatccggcccagtaatgctcctccaccgcagaaaagcggtgcacgatgcgcgagttatcggtcgccagcgcatccgccactttgtccgtcagggcgcggtttaaatccttatgccagtcggggaagcgtttttccatccacggcgagttccacggcggttcgttatggccgccccagacgataatggcaggcgagttgccgaactgctccaccatttcccgggtctggcgtaccgcgttgtcggcgaaggcggcactgtcatcgtagccccattgcagcggcacatcctgccagatcatcagccccatctcgtccgccacctcatacagcccgcggcccgccacatgaccgtgaacgcggatggcgttggcgttcatctcctccaccagccggaaatcccggcggtatttttcccgcgtcatggtgctgagccacggcgagccaatatagttagttcccttgataaacaaccgtttaccattgataagccagcctttattctccggctgttcttccactttgcgcaggccggtgcgcgtgacggtggtatccatgagcccctggctatccgtcagcgaggcgcgtacccgatataaatgcggtttgccggatcctttcggccaccagagctttgcggccttcatcggcagatctaccttcagcgtacgggcgctgccgtccgttttctccagggtgacaggaaattcctgctgaaagcgctggccgttaaaattagcaggagccgcgttcaggcgcagtgtggcgctgccgccttcaagggcacggtagcggatcgtcgcctgcaacgcgggattgtccagcccctgacgccagtccgggcgcaggatgatttcatcaatagttgcgcccctgctgagatgcagtctcaccggtgcccagataccccctgagttggcatcctgcccctccggcgaccaggcgccgcctggccgactatcgtgctgattaagcacgcccttcatcaaggctttatgcagcggccagattttcttcggatcttcgaacgggctatccacttttaccgccagcttattatgacgacgcagtgatttagtgacatccaccgcgaagcgctggaaatagccttcatgacgggtcagcgcctgaccattgagcgtcacatccgcaaagtaatcgacgccgtcaaacaccagcgtggccatggtatccgcaggctgcgcgggcagggtgaaggcatggcggtacatcagcgccccctgatgatcgtacccggcgctgtaccagttagccggaacctttagcgcccgccagcccgcggtggaggcggtggtgccatcaaaagcgctgtcattggcgtcatgcacctgccactgtccggcgagggaccaggtcacaggcaccgtggtcgcccgggccagcgggacgagggcgaccagcaacagcatgatcttacgcaccattttttacctcctgcgcccggcgttgcagccacgccataatgcgactggcctcggcatacaggccatcccgcagggttttcagttcgtcgtcatccagcgtctgcgcatcgctctccagccgttgcagcagttgcgtgagatgcccgaaatccagcgccatggcttcgccgcgcagtttatgggcagcgcggcgcaggccgtcacgatcatggttgttcatggcctgcacgatcgtcgccagcgcctcatccagtccctcgcggaacagacctaataactcgtccaccagctccgcatcgtcggcgcactgcttcagcaggcgggcctcatccggcagcccctgttccggggggcggcagacacgcaggatctcatcctgcagcgcgtcctgggtgacgggtttggcaatatagccgtcaaagcccatcgccaggcagcgctctttgtccccctgcatggcgtgagcggtcatggcgatggcaggctgatgcgtctgctgctcttcccgaagcaggcggatggcggtttcgccgtccatctccggcatctgtaaatcaatgagcagcacatcccagcgggccgcgcgccagcgttccagcgcttcacgaccgttattcaccacctcgcactcatgcccgagccgctccagcagccgccgggcaactttctggttaacgagattatcttccgcgagcaatacgtgcagcccctggcgcgcggtttcaggcgcggcctgtggggcgggcggcggcggtgtctcctccgcaggcggcaccggcgcaagcacgctggcgatcacctgatgtagttcgtgctgcgcaaccggcttatgcagatagtgggcaatgccgatgcgtttgagcattttggcgtcgaaatggcggctcattgaactgagcataatgatatggctgtggctggtctgcggcagcaccgacagctccagcgccagggagacgccgtccatatccggcatctgcgcatccagcaggatcagcggccagggcgttcccgccgccgccagtcgcagggcgtcggcggcgttattgacgcaggtgggttgcagtcccatcaggctaagcatggtatcaagcaggcgcaggttggtgctgttatcatccaccaccagtacccgttcgccgttaaagcgcgccagggttgagcggctggcggttgaggcctgctgactggtgagcggaatggtgaaggcaaactcgctgcccgcgccgggttcactggtgaccgacagctcaccgcccatgatcttcaccagcctggcggagatggtcagccccagcccggtgccaccatagcgacgggtggttgagctgtcggcctggctgaaggcttcaaaaatggctttctgcttgtccggcggaatgccgatgccgctgtcgcgcacccggaagcgccagtgacctgcgctgtcggcaggctcgatggccagcagcacttccccctgcggggtaaatttcagcgcgttacccagtaaattggtgaggatctgccgcagccgggtaccgtccgccatcagcacttccggcaccgtaggggcaatatccaccagcagttcgatgcttttttcgctggcggcgggcatatgcgggcggatcagcgactggacgaacgggcgaatttccaccggcgcttcgtccagcaccaccttgcccgcttcgattttagagaagtcgagaatgtcgttgatgatatgcaacagcgactgggccgagctcatcaccagcgaaagatactcccgctgatccgccgtcagcggcgtgtccaggcagagctgggtcatgcctaaaatgccgttcatcggcgtgcggatctcatggctcatattggcgagaaaggcgcttttcgcctcgttcgcctcgcgcgcgactttcgccgcttcaatggcgagcagctcggcttctttacgccgggtaatatcctgaagcgtgccgataacccgctccgcttcacgatcgatggtcatggtcaccacctggccggacagcagcatccagcgccatccctggtcgggatgacgcacgcggatctcgcactcgaagaccggcatatgatcttttttcgaggaggccagcgcctggcgcagggtggcgcgatcctcctcatgcaccagattcagcagaaaacgcaccggatgctgccactgcacccgcgactgcccgaccatcgccagcagggtatcgttgacctgcaggctatcctgcgacacctgccagtcccagatgccgatctggatcgactcggcggtcagtaaaaaatcttcatgcagctggtggcgggaacggcgggcctgatcgagctgggtaatgtcgctgtgcaggctgacgatgccgccatccggcaggcgctgatgctgcacatatagctgccgctgcccggactggcgcacttcataatgatatttctggcggcagttgcggataatggtttcacgcaggctctggcgtttggcggggtcgatgttgtacaccgcatcgataaatttttcggcaagctcttccagcgtggcaccggcggtaagccaggggccgatcaccggataaagctgcgtgaccttatcattccaggcctgcagtcgttcggcagaatcatagatcatcaccgccaccggcagcgcattcagatcgaagcaggacgatgcgttcatcatacctcctgtgcccggtagtgcagctctgcctgacggcgcagatactccagccccggcgcaatcgccatcgcccaggcggtgaggatctcgtcgtcacactcgggatcccgaaggtgaacggtgttcagcatcgcctcgcgccagagggcaaaaaagcgcggcggcagacgcaggccgtcgtgactttgctcgcgggcgaggcgttcgagaaaatccggtacaaacagcacgccgtccacggcgagcatggcgaaaaacgttttgtacatcatctgcggcccttcctcatcgggctggcgggagaagtgcagctccgtctcgggcgtcatgtgtttgaaagcgtcgtaaaaggcctgaaaaaaactctttttatcgttttcagggatcacccggttgaggctcgcctcaaagagatcgcggtaaaacttcatggcgcggccctcgcagcacgttcacccggcaggcacagtccgggcgggttaaattcatccgccagacggcgtgagaagtagctgtcctgctccatcaggccatttttaaacagcggcccggcgttgtgtttatagagcagcgcttccagcaccatggcattggtggagagcgtaagggatttgttgatgtcgccggtggcctcgacgcggccttcaaaccagcccttctgcggatcgttgagatgacgggtcaccgccatcagcgcgtcggtatattcggtgtcccacagcgtccatagggtaaagaccgctttggtcgaaacctgcgacagccgcggatagtcccggccatcgtcccccagggtattccaggcgtagccgttaccccacacggtatcttcgacatgccagggcgcctggccgagtgaaaaatcggcgcgggcggtcagcactttgtctgtttcccagcgtgatttctgggtgagccatacccgctcggcccgcgtgcgcagggtactctggaattcagacggcaggcccggcggttcccagccgaattccagccccggcagcatataggggagggtagtaatgagcgacggctgccaggtggtacggggatcccgggcgtcaacggcgaggctgcgctggtagatgatgacgttgcgcgacggcggggtaaaggccttgtcgaccgggaatccccacaggcggaacgcgctggcggcatattcgctttcgcccagccgcaattcttcgcgcaccaccggctggccgttttgcagcgacgaggaccagagttcgccctctttatccatcaccggacagaaattccagcgcaggataattttatccagatactcgcgatactgcggcgcgcgctcggcggtgaggcgcagcgccagcatcaggcgcgccatatctctggcggaccagccgctttttaccggttttccgctgaagtcgataagggtggcgctctgggtggaataaagtcggcccggcgtacgctgctcgctgagcatcaggcgattaagggtgccaagcagccgcgtcagacgggcatcaaactcatcctccttaatcagatccagctcgcgggcagccagcagggcgatcagcgtgtcgcccatctgccacagggtgacgcgaggttgtttatcgctgccgttgaccagcccggtctgcggctgggtgttattgacgaaatagcgccaggcgatgcccgcccactcctgctcctgcggcgtcagacggtcaatacgcgcgctgctatgccagccgcctttcgtcagccagcgccatcccgccccgtcgcgactaaatagcgcaaaggcgataagcaggacaatcaaaattcccgccagccagcggctcagggttttaaacattgcgccgtcaccggaggaagtttcacgggctcatccgccttacaggaggagcactggcaggcctggcacgcaggtttagtgcgctggctggtgccggtctgttcgcaccaggttttcaccgccggggtactctccaggaacggacgattccgtttggtgttgttctcctcaaactgatcgacaagtttcttctcccacagggagggcgcgaactggcgatctttcgggttatcgctgttaaattgcagcagcttgccctcttttttgaacagcagcgcctccagcatgatgccgttattgttggcggtgaactctttaatcgggccgtcgccgttttcatacagcccttcgtaatagcctttgccctcttcgttggcgttttcaatggtggtgagtaaccgatccgtgtaaggcgaatcccatagcgcccacatgccgagggccgcttttagcgacaccgcagcggtattaggaacatattgtcctttatcggtaatggtgttccagttaaagccatcgctgaatacggtgtcgtagacaaagtacggcgatttatcgagctggtgctccgaacgggcggttaaaatgccggtaatggcgtagcggttctcctgcgcctgatagacacggtcggcgaagtctttcatccacgcgagggaataatcgcgcgggctgttatcgcgatccgtcgggttatcgaaaccaaactccaggccgtaaagcaggtaggattcggttaccacatagttatgttgactggtacgacggggatcgcgtgaatcgtacggcaccagcacgcagtaaatttctgccagctcatagggttccggtcggcttgactggcaggtgctgaatccccataaacggaagcccgccgcgccatattcctcatagcccagacgtccttcctgaacatatttgggctggccgttttccagataagcgccgtataacatgccgcagggatccacggcatggctgaagtcccagcccagcacgatattatccacgctgttgccatattccggataacgctctttgatgaccctcaaccagatcagcatcctgccaatgtccagcgctgaaaagccgatctcgccgggtttgttctggtagttcaccttctgcccgctgatggtgttgtaggccttgttagggagttcatcacggaacagcaccagtttattcagcgtggcaagcaatttgatcatgcgccgatcgaattccgccttatcaataatccccagctcgcgggctgcggtcatcgccgccatataagacgcgctgtcccacatggtggtggacgggtatttgtttaccgcgttcaccagcccggtggtgggctgatagttggagacgaaatattgccaggcgtttttcgcgatggccatttcccgcgcgctcagctcgccgctgcggggatcgtagccggaagcaggcaattcagtagccgcccgtgcgcccgagatcgccagccagaacgccaccaatccggccaaaagtgggaaaaagaacaagcatttcagcttcatggcgtagctcctgctgaagaagtggatcgggatgcgtcgttaaaacaggccaggcacagcatctggccgtgggcaatgtacgccaggctttcaaggaccaccgcattggtatcggcgtcaatcaccttattcacgctgttattcagattcaggccgcgctgccagcctttgccgggtacctgtaacggctgcacctgctggcgtaacgcctcgctccagctgttgcggaacagggcataccaggcaaaggcggagcgggtggaggtgatggcagtctgctccggggtggcatcgagcagggcgctgttttgcaacggctggcgatccggcagatcgttgacgtagtccggcgcaggctcggcataatcggtactgatgggcggtttacgcacccgcaggctgttgcggcgctgctgaatttgcataatgcgccaggtgatttccgcgctttgcgcgtcaaagcccagttcgaggccggttaacagatagggcaggctaatgagcgacggctgtttgccccagggggtgcgcaacccttcgtccggcaccatcacgccatcgatgtcgatcatctgctgtccttccggcggattcgttaccgccagcccggcggcgctgtcgatcagccgcagcgtgtggctggcatacagccggtagccgtagctgttgcgcggctcgtctgtgttcagcgcccagtgatgcagcggcgcggcggcctgggtggcggtgctggtgaccaccatcgccccggtgttccactggttaaagagatcgcgaatggcgggagcgtgctggggatagcgccacagcagcgtttgcagggcgttcagcaatcgtcccatgccgatggcggaggtatccggttttcccagcattttcagcgtgtcggcgtggtaataagcggcgggcacgccctgcggattcagcggcaactgaccgagggtaaagagggcggcagtaacgcgctcgtcaaactcggcggcagtcagaatgttaagctgttttgccgcgctcagggcaaacaggtagctgccggtactccacaggctgaaccagggttcgcgatcgtgggcgttcgccaggccattaggctgggtgttgttgacgtaatactgccaggccacccgcgcccagatcgcctcatcaaaggtcagctcgcgggaggcgggcagcggcggaaaatccttgctgaggctcagcccgccgctgctttcaacgcgcgagggcatctggtgctccacccataccacaatggcaaacccgagcagaaaacccagcaggatggtgagatagctgcgggcggaaagcagggcgtcacgcgttctcattggctggcttcctcttcagcaggtgtccatatggcggcgaggatcaggggcaacatggcggcgatattcaccgcgccccagaaaatattgatcacgtagccggaagggtcatccacctggccgcgcgccacctgtatcccgccccagatcagccccgccagggttaacaccacgatggcgatctgcggtttcaccagatagagaaaacggccggtctgccgctctttcggcgttacgtggaatttgatctgctcgccgcgcagcacggtatccagcgcccgtaagttcatggaaaagaaggagaggtaagaggcgcggccatcccaggcggaaatcccccaggtgccgaacataaaggccagctccgagaaaatgaaaaaaggtaaaaagtgcaggtaaaagggcgttgaccaggcggaaaccggcggaatgccggtgaacagataaataatcggcgagatcagaaataccgtattccacacgcaggccatgtaagaccagaaggtggtggcatacatcagcgtttgcggcagcgacagcttaaagcggcgacggctgaagatgttgtcatggaagagaatatccagcgatccggcggcgtatttaaagcgctggatcatccacgtcagcatatcctgcggcgagagcattttggattcgatgcgcggatgcatcacggagcgccagttgcgcgccgcatcgccgtgcagcaggatggaggtgtaaatatcttccgagacgtgaaatttatagggcgtcagctctgtatcaaaggcgacgtgcgggcgcatggcatcctgcaaggcttcgcgcgtggcaggatcgcggatgtcgcgggtgtggcgggaaatctcttcttccaccgtccatacatagctgcgtaacgccgcctgcatcaccgcttcgcgacggtgaatggatgccgcaccgcaacagaacgccgcgttggcccagttacgccgccgcaggatcacgtcataaaacatgcggggatcgttgaaaaagggatcgcggccaatggtgatcgggccgacgattttttgcgccagccagccgaggccgtagccaggcttgcccgctttacgccccagccagcgcgccaggctttccccttccggcaggtcgtaaaaccactgcggcgtctgcacccaggcgacatccggatcgcggaaatagcccagcgtatggctgagcagtgtcgggaagacccgcgtgtccgcatcgcagataacaataaaatcgccgtcggtttgctcaaggccgttacgcagattaccggccttataaccgatattggtctgacgggtgatgtaattgacgccttcctcatcgcaaacggctttcatctccggccgccgtccgtcgtccagcacatgcacctgataatcgagcggaaaggggtactgcattttcatcgcatcgcggatggacagcctgaccagctcgacgtcctcagaataggtggcgatgaacagatccactttcactggccgctgctccaccgcgtcttcagccagcagacagtcgttgatctccgcgggcggcgggttctgcggcggatcctcttctttccagatattgatggtaaataatactgtgccgatccaggcgaaggtttccgccagcaccagcggcacggcgtaccacagcgcatcggtattcagagaggcagtccagcgccagtaaatataattgccgcccagaataagcgccgctaccgctaatacctgccaggtcatcatcacccagcgcggtgttttaagcggttcaggcggcctgcgattttcaaaacgggaaaagtaaaaatccatagcggtggatatcctgcttccgtgatgatgaattattgatgcattacaggcaccggcctgcccggaaaagtaaagtcaaaacaaaacgaaaagtaaattaagtgtagaagcccgtaaaaaagtgtccagcagaataaattgccataatttagccgggcttaacttactatcattgtcactaaataaaaaatgagtgccgatgaataattgccagaaccatttatttaagctaaataaataatttgaaacatttttttgggatgagtgtaagggaaacctatgagccagattgcgccagcgctaccaaaaaaagaaactgaaaaatcagtgtcatggcgctatgcgatcccgggcaaccgcgatctgcgtattgacctgatgcgtggcattgcgctggtaatgatggtggtggcgcataccgagttactctctgtttttaatattttcacctgggaacgattcggcttaactaccggtgctgaaggattcgttattctttcaggatttatgcttggcatgttaaatcgcgcgcgtctccagaaagtagtattgcttactgtatcgtggggactttatctccgggcatggaaaatatatcgtgtaaatatcattattatagtttccttcttattgctggggtatttgccgtttatcaatgtttttgaagtaacccattttaccgatcgcttttccggtaccacctggtccctttatccggtcacaccgcaaatcaaagaaacctggtttaatatcattctctatttgcagataggcccgcatcagacgcaaattctcggcctgtatatttttttgttactgttaagcccactatttctggggatgctgagtaaagggaaagtgtactggctgttaagcctttcactgctggtgtacggctgctggcagcgctggccgctgcgcgttacgccgtccgaatttgagttcgcctttccgctgctggcctggcaatttatctttgtgctgggcatgtgtagcggctggtacaaagaagagttgctctcttttgcccgcacgccctccggcaaagtggtggtggttgccatggtggtgatcgcccttatcctcgcttttgtcgcccagaaccataccaacccctttatgccgcacgccctgctgatgcatgtgatttcccctgccgatttcaacgccttttatcatacctgggcggcgaaaaacggcctcgggccggtgcgggtgctgaacgatatttgtctgatggtgacggtctatctgctgctcagctggtgctggctgccgatctatcgtgtggcggggtggtttctgatcccgctgggacaacgctcgctttataccttcattttgcatgtctatgtggtgctgctggtgagccagtttgtgaccttcgatttatggcggcaggcatggatcgaaaacaccctcattcacgcggccgcgctgggcgtgttatggctgatggcgaaatacaacgtcgccgctcgctggatccctaactaaggaaaggcagtatgcgtgagaaattcttgctggcctgcgcgctgctatcggccgccaccgcaacggccgcagcggaagcagacaaaaaagagactttacgggatgaagccggcgaaccggtgcaggtgggggttttcaccagccgctggggacggcttttctccggtaatgaggataaattttccggggcgctgagcttcacttcagggctgaaggagcagaggatcgccattcctaacagttcatccacggcggagcagaaaaagaaatataaccagacgctgaacctcagcctgcaatattcaccctacagcttctggttcgctaacgtcacttcccgtctgccggtgacggataccagccgttacacggcggatttccgctacagttttggctatgacgactggcacgccaataccgttagcctggtctacagcaactatggcgacaatcacttctggacctccggcagccgccgtaacacctattttgagcagggcgccgtgacgctggcctataaattctcgctgccaaagcccgtggaaaacgcgctgttgatcaataaaggcgactccattatctgtcaggcgggctacagctgggtgccgcgctattacgatttaagcagcaacgatatccgcaaaaacaaaaacgtcatgctgggcggctgcggttataccttcaaacagcatttcttcgtgcgcgccacggcgttctggtatcccgacagcagtcagcagcagccgtggaacggcgattacagctacagttttggctatgcgggctatacgccgggatctttttccgtgcagtacgccaactattccggcacgcgttatccgggtcatcagaccggcaatgggaaatttcgtgaaggcacggtcagccttacctggttcttaccgctataggggataccatgtcgccacaacaggttctggttgttgaagattcaccggtttaccgtcgtctgctggtgcggatgctggcccagtggggctatgcggtgagcgaggcggaaaacggcatcgccgcgctgcatattctggaaacccagccggtgagcatggtgatcagcgactgggaaatgccggagatggatggcctgacgctgtgccgggagatccgtagccgccagtttggtcactatatttatgtcatcctgctcaccgcgcgggaaaataccggcgatgtgacccttggctttgatgcgggcgcggatgattttctcagtaagcccgtcgagcaggcagagctgcgggcgcggctgcatgccggggcgcgtattctgacgctggaggcgacgctggcggcgcacaacacgcggcttagcgaagcgctgcggcagattgaactggatctggaagcggcggcgcgtattcagcactcggtactgccgtcccaccagttgcgctatcaggattttttttccgactggctgtttttgccctcggcctgggtatcgggggacattttcaacgtctttccgctggataaccatctggcgttttactgcgtcgatgtttcgggccatggcgtcggcgcggccatgatgtcccttgccgttgcgcgccagtttctgcatggccgggcagtggagcgcttcttatttgccgataatggcgaggtggcatcccccgccgatgtggtgcagatcctcaatagccgtttttgcagcgaagaggcagagatcatgagctatttcacgatgatttatggcgtcatcgatctcgacagcggccagggacggctgtgccaggccgggcacccgacgccctttatcatcactccgaacggcgacgcgcgcgccgtgggcaacggcggcgcgcctgtaggcttaatgcccgatctcagctgggaggacgtgcacttctcgctggctgcgggcgagcggctgtgcctgttcagcgatggtattaccgaatgcgaggatccgaccggcacgcagttcggcccgcaatctttacaacactggctgcaaagccacacaactttgccgctggacgaactgctggcgcagtttggtcaacatttgatccgctggcgcaacggtgaaggcgatggcgataacgcgatggccgatgatgtttcactgctgctgatcgagcgaaaaggagaagcgtaatgcacattgatactgaacgacatctgaacatgaatatcctcaccccttcaatccgccgcctcgacgcctccgttgccgcggccttcaaagaggcgatcatgcgggaagtgggggaagatcgtaaggcgctgatcatggatttcagcaaaattgattttatcgacagtagcggcctcggcaccctggtgtcgctgatgaaaatgatgaacggcaggggagaaatggcgctgtgcagcatgaacgccgggatccgcaatatgtttaccctcacgcgtatggatcgtattttccgcatctgcgccgatcgcgcagcggccgtcgagcagctgaaccatggcggataaacagcgttttgcggcgtcgctccgctcgcttacgccgctggccgggtggctggcaaaccatatggcggatctgccggtgcaggaggagtggcagttcgcccttgatttagccgcctgcgaggcggccaccaatatcattcgttatgccctgcacgaggacgacagccgatcctttagcgccgaatttaccgccacggacgaagaggtctgcctgcgctttaccgacagcggcgacgccatgcctgacgggctgattgaggcggcgcgcgcgacagactttgcggagatgtcgccgctgatggaaagcggccggggactgaagctgatcctgctgtgcgtcgatactttcgattacgcgcgcgaggcagaccgcaatatcaccacgctgataaaaaaggtggaaggttaaatcggctcccgctccagccagaaaatcaggcgggaaaatatctcgttctgcatggccaccttgttgtacatcatgtaggtacgcaccccgttcagctcaaaatctgtcgccagttctcgtaggggatacagatgccgactctgttcatacagccaggccggaataatgcccagcgtatcggtatgggctaccaccgcgggaatactctgcactgaaaaactgctgtagcgcacctgacgttcgccgaactgactttccacggtggccagcgttgactgcaatcccagccgtttggtgttgagcacggcgaatttctccagccgggcttcggcggcgctgatctggctgccgaggcggggatgatcgcgtcggcagatcacactgagcttttcgtcgaggatcgccgtggtgacgatggctgaatgaaagacaggctccacatcaaacaccagatcgacatcgcgctgcaaaagcagcacgtccggcgtgtcctgggcgcgtatcacatcccggtgcacgatccggcagccgggggcgttgagttcggcccattgcacaatgcgtggaataacgcgcgtcgcaaaccaggcgctacagtggataaccagtaaatctttggtggtggcgttcgccagcgcctccagcgaacttagcaggccgctgtactgtttcgcgatctgcaaatgaatagtttccgccatagtagtgggtgtcagactctgcccattacgcacaaacagcggatcggagaaatagacgcgtaatttctgcaaagacttactgataaaggccggggaacaattaagcgcctccgccgcgcgcgttacgctgctgtgtttataaatctcattgaatattcccagcagtttgaaatcaaaattaacgccgattaccgattttttgcacatctactgttccttcagaggtaggctggtggtcagctttcatcaatgaaagctatcatttaagtaacatctcctggcgtgaaacattccggttttcacgagccataaaagatagatttttaaacaatgtaagaaagttgttgcggttttaacatttttaatttgttgtttattaagggttaaataagaaattgctcttttttattccatatgcaggcatacttaacccggcggtaaaaatcttattaccctgacgaatctttcggcctggtcatttctgtaacataattccctgaacactcagtttatattatctggaacaatttcgttaatacctaacctgtatcttgtttaaatatttcctgtggttatttgtctgcgcttttttaaatcatttattcagatatttatcaagttaatgaattgacaacgcgtgcccgtttaaaggtcgattatgaataaataccgtttatatcaacacgccattattatgatggcaggcttattcccgttattcccctgcgtcgttcatgccaccggtatggttcctgaaacaacagcgctgttaattgatgaagaaaaaggcggcgcgagcatgaacgtaaaaaataccgacaataaagcggcgctgctttataccaccgttcaggagccagacggcacgccagcgcaggacgcgactctcgtcgttacccagccgattgtgcggctggaagccgggcagactcagcgggtgcgctttgtgctgaataccaccgcgcctttaaaagtggagcagtacaagcgggtaatttttgaggggatcccgcaggcaaaagcgccgggtaaaaaacagatcaccaccaccattcgccagaatctgccggtaattattcacccaaaaggcctgccggtattaaccacgccctgggaaaagctggagtggtcggccgcaggaagcaccctgacagtcactaatcccggcgcttatgtggtacgtctctcgccgcaagtggtgatgcagccgtctggcgtgacgggcagcctcggaaaaacctggatcctgccgggtgaaacgctctccatctcgctgaaatcacccaccaccgataaacaggtgaagcttttccccgcttcccgctatggctttgacgtcggcagctatatcgccattgtgaaatagcccgtgcagatgagaaaggatccactgttgctgatgagcactgtgctggcctgcggggtgttcagcgcaatggcagcgtgcgccgcgtctgaaggcgtttcaccgacgaacggcagcgaagccgcgctggagttcgatctgcagatcctgcgtcagcgcggtgtcgacccggcggtagcgggctatttctcccgccgtgcccgctttgcgccaggcaggaagacggtagatgtgtcccttaacggcaggcgcgtcggcagtattgccgtgctgtttaacgataacggcgatccctgcgtggatcgggcgctgctggaggctctccgcctgaaagcgcctgcatcggacaagggcgaccgctgttatgactatgccagtgcctttcccggcaccctgtttaccctgttgccgacggaagatcgcattgagatggtcacgccgccggaggcgctgttgccgctgtccgggacagcggaaaattatgccaccggcggcacggcggcgctgcttaactattccctgtttaccagcagcagccagacggacggcgggcgatacgactaccgccagggcacgtttgaaagcgggctgaatttccacgactggctggtgcgcagcaagcagatggtcagccagtccgacggaaaaatgaacagtgaccggctctacacctacgcccagcatacctttaccggcatcaagaaaatcgcccagctggggcagatcaacgtcggcagcacgctattttccggcagcgccattaacggcgttcagttggtaccggcaacgacgctggacaacgacacggggagcggggtgacggtgagcgggctggcgcagatgccgcaggcgcgcgtggatattaagcagtccggcgcgctgattttttcgacgctggttccggcagggcccttcaccctgaaggacgttccggtgatcagcgccaataccgatctgcacgtctcggtgacggaaaccagcggcgcggtgaatacttttattgtctccgccgccagcttttccagccgactgcctggcagaccgcaagggctgtcgatggcgctcgggacgctgcgggacgtggagacgccgttcgataaaccctggctggcgaccttttcaaacggctggcagatcaccgatcgcttcaatctgtctgcggggctgacgaccgccaacaaatatcaggcgctggcggcaggggggatctgacgccggtaaaggatctgctgctgaatgcccgcctgcttcgcgcccgcgatcggctcaatagcaatcaggggcaacagctgacggcctcggtcagctacatgacgccgtttcgcctgaacctgagcctgtccggcacgcagaacagccggggctaccgggatttgcaggatactttcagcgagggggaagcgctccataccaggcatgactacgccctgtcactgggctggtcgcatcaactgacgggcagcttttcgctggggtattcccgttcgtctggatttgacgccagcagcgacgccacgcgcctgaccgcttcctggagcaaaaccttcagccgggcctcggtaaatcttagctggcagcatgaaatcgaccgggactccgggcgttatgccagcgcggcttaccagagcggcggcgacaccttatacctcaatgtcagcattccgtttggcgcacagagcctcaacctctccgcccatgacgacggcagcagtacccgctttggtgcgcagacggcgggcaaaataacgccacaggtcggctacaacctgtcggcggaaactacagacaaccacggcgaacgccgcataaacggcggcctgaccgccaatctgcgctacgtccaacttggccttaacgccgggacgagcgggcataacagccgcaacagctcggcgacgctcgatggcggcatggtagcccacgcgggcgggctgaccttctcgccttacgccgtgcaggaaaccttcggcatcgccaccctcgatatacccatgtcaggcgtggaaatcagcacgccgcagggcacggtatggaccgatcgctggggcaacgccgtggtgccgtccctcgctgcttatcaacgctcaaacgtcatggtgaacactgaatcgctgccgaaaaacgtcgacatcagtaacggtatgaggacggtgagcgccgggcacggctcggtaagccagttgcagtttggcgtgctggcggtgcgccgcgtgatgctgacgctgatcatgccggacggcagaccggtaaacaaaggcacggcgattttcaatgccgccgggcagtacgtcaccactgcggtagaggacggcgtggtctttatcgtcgatgtggaaaacagcggtgagctctacgcgccggtcgatgacgcgggccaccagtgtcgtctgatctttgcgcccggcgatgagccggatctggacgcattttacgaacacgcccgcgcaacctgcgtggcgggagaagctttatgagatcgaaactgaccgtgcctgccgtcgcgctgctcctgctgagcagcacggcgcggggcgacatcaacaactgcgtaatgcagctctcgccgctggagcatgactacggcgatctgacccgcgatcgtcagacgtttattaccacgccgcagggaaaggttgcacagcttagtgaacgccgtagcaacctgagcgtcacttgcccggaaaaagcgctaatgcggctgcgcttcaccggcgacagccatgctgacggcagctttcgctttggcagcaagggcaggctgaacgtgactatcggagaggcggtactggatggcaacccgatgttgttaaccagaaccacgccccagggcgacgccgtggccgccagccacagcctgcgcgcggcggatgaaatcatccccggcaatagcagcgtacagggtcacaacctcaacctcaccctgactatcacgccataccttgccggggcggcgtttgtggtcccggacactcagctacaggaggaacttatccacatcgaactactgaacacgcagtaatggaaaagggcagtcgcccgccagtgtattcataacaagcaagagatggagcaataaaccatggaaatgaagtccgttctgaaaaccaccgcgttaggcgtcctgatgatgaccgcgatgaccgcgcaggccttgccggtcaataccaatctgatcgtcaaaggcaccattacgcctgccgcctgcgtgccgacgctggctaacaacggtgttatcgactttggggacacctccgccggaagactgccagaaaatggcagcctggcgctggaagcaaaaagcctgaccgccacagtaacctgcgccagcgccgccagcgtggcgatgacctttaaagataaccgtgcggataccgtttcgctggtcggcggtgaaagcacgaaagcggaacaggcgtttgggctgggtaacgccggggggatcaatattggttcgtacggtataaaaatcacccatatcacgggcgacagcgccgatggcgtggtgctgcacagtagcgataaagagagctggtccaaattggcgtcgacggaattcgtcaataacaacgccgtcccgcaatatctgacttttgggctcagcggcaacaatgtgccgaaagaagcgaaagtgctcaccttcgatctgcaggtcatcccggcgctgaattcagctttaaaagacatttctgaagcagtaaaccttgatggcaatgccaccctcagctttgagtacctgtgaggcgcgcggaattccggcaactcaccagataaaaggaatcgattaatatggaaaataactcaatgaaaaccctactgaaagccactgctctggcaggcatgatgctgacagcctccgcaggcgcagccattgatgataatacgctgcaagtgacgggaactgtgacgccagcatcctgcctcccggcactgtcgaacgggggtgaagtcaattttggcaatacgatttcggaaaagctgacgcaaaaggataaccagctgccgcctaagaccctcacttttaccatcacctgcgaccatgcggcgaaagtatccctgcatatggttgacaataacaccgtgggtcaccggctgatggtcattaaaaatgcttaccataatgatgacgacaataatgaggccgcctaccagttcggcatcggcaaaaacagcaaaggcgatgccgtgggcgcgtacagcgtgacaatcgccggcagtcctgtggtgaatggtgacgccaccaacgttattgtctccgctggcggcgtctgggggtatagccagactcatgcgtttaccaacgggactggtgttaacgctttactgagcgtggcaaaacctgatggtgaaattatcccgatggcctttaaggttctggaaatgacgctgagaattaatgcggccgtggcctctaacacggatgtggagatgaccgacgccattgagtttgacggcagctccactatcgtaatgacttacctgtaattctccggaatatcgccctgcggcaggctgattaatacctgccgctttctttttcccgccccgtagtcaccacgcgttcatatcggtatgctaaattcgacccaataaaaacaacacaccgagccaatgtcatggataaagcactcctggatgcgggctaccgcctctacagcggtcagcaaatagatgtctatttcaataccgcactctgtcagcatgccggaaagtgcgtacgcggcagcgcggcgcttttcgatctgaaacgcaaaccctggatcatgccggatgaagtggatgcggcaacggtcacacgcattatcgacacctgcccgagcggtgcacttcagtaccgccagaaaaaagagagtgaataatggaaatccttgaaggccataataaattttatgtgaataatgccgacggcgagcagatcgcggaaatcgttttcgtcccgaccggcgagcatttaagcattatcgaacataccgatgtcgacccgagcctgaaaggtcagggcgtcggcaaacagctggtggcgcgcgtggttgaaaaaatgcgtcaggaagagcgaaaaattatcccgctctgcccgtttgccaaacatgagtttgataatacccgcgagtatgacgatatccgcgcctgatagtacgcatgtgagtatgcaatgcgaagtcatcggcgtctgaatatataaagcccgcataatgcgggctcttaaatttcagttacaggttaagcgcaattcgcttaccgtctggcagggtaacatctaacgttaactctccgcccagcgccgtaacatagcgcttgagtgtagaaagtttcgggtcattatcgatcttctccatcttaacgacagaaggctggcttacgcccagcgcggcggcgagttgtgtctgcgagacgtttagctcttcgcgcagtttcgctaaggtaatttcctgacgtatttcagcggcacgcgcctttatgcgatcacggctttctggagagcgtttagccatcatttctttaagcgtcgccattttctttaacctccggtgatttcagatgcgatttgaactcagcatcggcaatcttaatcatacgtttatagaagattttatccgtttcacctttcttatctgccgcgcataacacaatcgcttttcgctgcggatcaaatgcgaagaatgcccggaatggatgccccgcaacctgtacgcgaagttccttcatgttctggtattgcgatcccttgatctggtctacctgtggtcgtcctaagtgtggaccatcctcttcgagaatgacgaagtgggctaaaatttcttcctgtacttcctcggtctgttcctcaaaccacctatcaaacagctttcgcgtaatgatttcccacaccaattcccttatctcctataacctgcgggttataaaattttataacccacaggttataatggcaagtgatttcccataaaatagcctcctttaaagatttataatgattctcatgaatgcattcccgatatttagtaaaaagccataacattattatctgatgtccttttcttttattgattattcctctgacccgctgcactgcgctggtacaaatatggtcgactttagtgcagcgtcatcttaaatatattcccgatatatataaataaatcaaattaatcattgagttaactttctggcacggcagttgctatctggatttcatcttgtataccaacagggatccagaacatgacagcaatgacaggaaatacgttgtcggcatggcaacagcatatccaccagcatagcgatgacatattttcactccttgaggcgtatgccggatccctggcgtcggaagataacgcctggatcgccattgccagcgctgcgcagatccgcgagcagctcgacgccttattgccgcagtaccagcagaacccgcaggcgctgccgttattcggtattcccttcgcggtgaaagacaatattgacgtcgcgggctggccgaccaccgccgcctgtccggccttcgcttatgctgctgagcgcgatgccttcgcggtggcaaaactcaaagcggcaggggcgatcgtcatcggcaaaaccaatctcgaccagttcgccaccgggctggtgggcacgcgctcaccctatggcgcggtgagcaatacttttaacgcggattacgtcagcggcggctccagctccggctcggcctccgttgttgcgcgcggtctggtgccgttcgcgctgggcaccgacaccgccggatccgggcgcgtcccggcggcctttaacaatatcgtcgggctgaagcccaccaaaggctggctctccgcgcagggcgtggtgcctgcctgtcggctgaacgacacgctgtcggtcttcgccctgacggtggaggacgccttttatatcaccacccttgccgcaggccacgacgccggggatgcctactcccgcgtgcatccggccagcgcgcctgccgccatttcacaaaatccggtgtttgccatcccggcaaccctcaccttttttgacgatgcgcaggcggaagccgcgtgggaacaggcgttggccgcgctgcgcgcaagtggcgcgaccctcaagccgattgatttttcagccttcacccgcctcgcagaacagctgtatcaggggccatgggtggcggagcgtaccgccgctgttggtgaaatgctggatcacccggcgcaaatggatcccaccgtgcacgggattatttccgggggcctgaaattcagcgccgtggaagcgtttcaggcggaatacctgcgcgcggaactggcgcagcagattaacgccgccctgcgtgaggtggatgcgctggtggtgccgacctcgccgaccattcacaccatcgatgagatgaagcaggagccggtgcgctttaactcgcagtttggcacctacaccaactttaccaatctggcggatctttccgcgctggcgctgcctgcgccgttccgcgccgacggattacctgcagggatcacgctgatcgccccggcctggcacgatcgcgcgctggcggatttcggcgtgcgctggcaacagcaactggcgctgccgctgggggcgacggggcgggatttcacgccgtcctgcacgccgctaccggtgtcggcgcagcatgtgcgcgtggcggtagtcggtgcgcatctgcgcggtatgccgctcaatttccagctgactacccgccgggcggtctttgtggaaaccacgcaaaccgccgcctgctacctcttgtatgcgctggcgaatacccagccgcagaaaccgggtcttgcccgcgcggatgagggggcggccattgaggtggaactgtgggacatcccgctggcccgcttcggggaattcgttgcggagatcccgccgccgctcggcatcggcacgctggagctgagcgatggccgtctggtgaaaggctttatctgtgaaccggcagcgctacctgatgccacggacattaccgcattcggaggctggcgcaactggatcgcccgccaggagacccgccatgtttaataccgtccttatcgctaaccgcggcgaaattgcctgccgcgccatccgcaccctgaagcgcctcggcatcaccagcgtggcggtgtactccgacgccgacaaaaacgccgaacacgttaaacaggcggatgtcgcactgccacttggcggagaaaaagccagcgacagctatctgcgcatcgacaaaatcattgccgcggcgcaggagagcggggcgcaggccatctggcccggctacggttttctctccgaaagcctggcgttcgccgccgcctgcgacagcgccgggatcgtctttatcggcccgaccgcagaacagatcggcgagttcggcctcaagcaccgcgcccgtgagctggccgccgccgcaggcgtgccgatgacgccgggcaccggtctgctcaattccctgccggaggcgcttaacgccgcggagttgatcggctatccggtgatgctgaaaagcaccgcgggcggcggcggcatcggcctgacgcgctgcgccgacgacgaggcgctggcacaggcctgggaaagcgtgcgccgtctgggagagcagttcttcagcgatgcgggggtattcctcgaacgctgcatcgatcgcgcgcgccatatcgaagtacagatttttggcgacgggcagggcaacgtggtggccctcggcgagcgcgactgctccctgcaacgccgcaatcagaaagtggtggaggagacgcccgcgccgcatctgccgcccgccacccgcgaggcgctgctgaacgccgccgtgcaactcgggaaacaggtgaactaccgcagcgccgggacggtggagtttatctacgacagcgcacaggacgccttctattttctcgaagtgaacacccgcttacaggtggagcatccggtgaccgagtgcgtcaccgggcttgacctggtggagtgcatgctgcgggtcgccgccggggagtccatcgactgggcgcggctggcgcaggcaccgcagggcgcggccatcgaagtgcgtatttacgccgaaaacccgctgaaaaacttccagccaagccccggcgtgctgaccgaagtggtgttcccgtcggacgtgcgcattgataccggcgtcatcaccggcagcgaggtgtcagcgttttacgatccgatgatcgccaaactgatcgtccatgcgccaacccgcgaggcggcgctggcaaaacttcagcaggcgctgaacgccacgcgtctgcacggcatcgccaccaacctcgattatctgcggcagatcaccgccagcgacgccttcgtggacggcaacgtctggacgcggatgctcgacagcgtaacggtggagagcgcggtaattgaagtgctgcaacccggcacctggagcagcgtgcaggattatccgggacgcctcggctactgggacatcggcgtgccgccgtccggcccgatggatgattttgctttccggctggcgaaccgcattgtcggcaaccacgacgcggcggcggggctggagtttaccctgcaaggcccggtgctgcgttttcacgccgcggcggtgatcgccctgaccggcgcggactgccaggctaccctggacggcgagaccgttcccctgtggcagccggtaacggtgcaggcggggcagacgctggcgctgggccgcgcgcaaagcggttgtcgcggttatctggcagtacgtaacggtatcgacgtgccggaatatctcggcagccgatccactttcgcgctcgggcagtttggcggtcacgccgggcgcaccctcagcgtggcagatctgctgcccatttcccgtccggcgctgatcgcctgcaccacgcccgtgccggtgagcgagccgcaggggctgtcaccggtgctgatcccgacgtatggcgatgagtggcgcatcggcgtgctttacggcccgcacggcgcgccggatttcttcacccaggcgtccattgacgacttctttgccagcgaatggcaggtgcactacaactccaaccgcctcggcgtacggctggtcgggcctaaacccggctgggcgcggcccaacggcggcgaggccggactgcatccctctaacgtgcatgactgtgaatacgccattggcgcaattaactttaccggcgattttccggtgatcctcacccgtgacgggccaagcctcggcggttttgtctgcccggtgaccatcgccaaagccgaactgtggaaagtgggccaggtgaagcccggcgaccgcatccgcttttatccgatgagcattgaggaagcggtggcgcgggagaacgccatggatcgcattatcgactcgctgcaaaccagcccgctggctacctttgaggtgccgtccctggcggagcgcaacggcgtctccgcggcggcgctggtgtcgcttccggcgtccgccggtgcgccggccattgtctatcgccaggtgggggataactacattctcatcgagtacggcgataacgtgctcgatctggcgctgcgtctgcgcgtgcacctgatcatggcgcaactgcgtgagctgtcgcatcccggcattaaagagctgtcgccgggcgtgcgctccttacaggtgcgttacgacagcaagcttatcagccagcaggcgctggtggcgctgttgctggaaaccgaatcgcgcaccggcgatgtcagccagatgaaagtgccgtcgcgcatcgtgcacctgccgatggcctttgaagatcgcgccactcttgacgccgtcagccgctatcaggatacggtgcgcgccagcgccccctggctgccgaacaacgttgattttattcagcgcattaatggtcttgaaagtcgcgaggcggtgaaggcgacgatttttgacgccagctatctgatcctcggcctgggcgatgtgtacctcggcgcgccctgcgcggtgccggtcgatccccgtcaccggctgttaagttccaaatacaacccggcgcgtacttttaccgccgaaggcacggtgggtattggcggcatgtatatgtgcatctacgggatggattcccccggcggttatcagctggtagggcgcacgctgccgatctggaacaagttcctgaaaaacgaccagttcagcgcgggcgaaccctggctgctgcgcttcttcgaccaggtgcgtttctacccggtcagcgaagaagagctggatcggctgcgggaggatttccgcgaaggccgcgccaccgtgcgcatcgaagaaacggtgttcgatttcccggcacacctgcaattcctggacgataacgccgacgacatcagccgtttccgtcagcatcaggccgccgcttttgagacggaagtggagcgctggcagctggacgatgacagcagccaggagatcgcgccggtggcagaagaagcgatcgacgaggacgcgcagccggtgatggccgacatgagcggcaatatctggaaagtgctggtgcagccgggcgacgaggtgacagccggacagccgctggtcatcgtcgaggcgatgaaaatggagctggcgattgtcgcgccgcaggcggggcgcgtgaagcgtcttggctgtaagcctggccgtccggtcaatcccggcgacagcctgctgtggctggagtagcacgatgcaaatggcggcgagcggtaaaaatgacaaaacgcgcagcgcggggctggcggaacgcatctatcaggcgctgaaaaacgaaattttcgatttccgcctgatgcccggcgagcatttcagcgaaagcgagatctccgcccgtatgtccgccagccgcacgccggtgcgtcaggcgctgttctggctggagcacgaaggctatgtgcaggtgtattcccgcagcggctggcaggtgcggccttttgatttcacctactacgaagcgctgtatgactttcgcatcgtgctggagcgggaagcggtgcgccgcctgtgcggcatgccgccgggtctctgttcagagcatcttgcgccgcttaccgccttctggatcgccgcgccgcgtatgacgccgggcaaggcgctgtcgctgatggacgaacagtttcataccacgctggtgcagagcaccggcaacagcgaaatggtgcgggtgcacgtcgagctgacggagaagatgcgcattattcgccacctcgatttcacccgcgaggatcgcgttgaggcgacctacaacgagcacgcccgcattttgcaggccatcgaagatcagaacaccggggaggcgcaacagctgctgaccggacacatttcccaaagcaaagccgaggtcagaaaaatcacactacacatgctccagcaggccagtttgcaacccgtttcaccgtagtcaacaacaacactcactcaataccatttaggggtttagtcatgaaaagacgttcgttgctgaaagcatttgccctgtccgccacctttttgagcatgggcttttctctacaggcatacgcagcagagaccattaaagtggggatcatgcactccctctccgggacgatggcgatctctgaaacgccgctgaaagacatggcgctgatgaccatcgccgagatcaacgccaaaggcggcgtgctgggtaaacagctggagccggtggtggtcgatccggcctccaactggccgctgttcgcggaaaaagcccgtcagttactgagccaggataaagcggcggtggtgtttggctgctggacctcggtatcgcgtaaatccgtgctgccggtatttgaggaactgaacgggctgctgttctacccggtgcagtatgagggcgaagagatgtcgccgaacgtcttctacaccggtgccgcgccaaaccagcaggcgatcccggcggtggagtacatgatgagcgaagacggcggcagcgcgaaacgcttcttcctgctcggcaccgattacgtctatccgcgcaccaccaacaagatcctgcgcgccttcctgcacagcaaaggcgtgaaggatcaggacattgaagaggtctatacgccgttcggttacagcgattaccagaccattgtctccaacatcaaaaaattctcggccggtggcaaaacggcggtgatctccaccatcaacggcgactccaacgtgccgttctataaagagctggcgaaccagggcatcaaggcgacggacgtgccggtggtggccttctcggtgggtgaagaagagctgcgcgggatcgatgccaaaccgctggtcgggcatctggcggcgtggaactactttgagtcggtcagcaatccggtgaacagcaaatttgtcgccgattaccgggcgtatgccaaagcgcacaagctgccgaacgccgataccgtggtgaccaacgatccgatggaagccacgtatgtcggcattcatatgtgggcgcaggcagtggaaaaagcaggcaccaccgacgtggataaagtgcgcgcggccatggccaaccagtcattcgccgcgccgagcggcttcaccctgaccatggacgccaccaaccatcacctgcacaaaccggtgatgattggcgaaatcgaagataacggtcagttcaacgtggtgtggcagacggagcaggcggttcgcgcccagccgtggagcccgttcattgccggtaacgacaaaaagccggatcacccggtgaaaaccggcggtaagtaattcccgcagggcagaggcgtggggcggcagacgcggccccacgctgtggctgaactcacccggaaagacagtgacatgatgaaaatactcccggctttgggcgttcttcttttaagcggtctgctgatggcaagccacgcatacgccgggcctgccgctgagtacggtcaggccagccgcgcgcagcagatccagttgctccagcagtgggccgccgcgcctgaagcttcacgcctgccgtttctgcaaaagcttaatgaggcggaagtggtgacggatacgcgcggtcagctgtttacgccagcgggtgacaaatttatcccgctggaaggcgaggccgccccggtgggcagcgtcaaaaaaatcttccttaataaccgcctgcgcgggctgatcaaaagcgcgctggcctcgcatcaactggtcagccccgatgacgccgtgcggcttcaggcggcgctgacgttacaggctaatgctcaggccgatcagctgccgctgctcagcgcgcgcctggccgcggaacaggatgatcgggtacataccgcgctggcgattgcggtggcgaatttacagctggcggacagccgggcggaaaaacgcctggaagcggtgaaactgctgggtgaagccagcgatccgcaggtgcaggccagcctgatgcgcctgacggatccgcaggcggagccggatccggcggtgcgtgccgccgcggcggaaagtctggcgcaggtgcagcagcgcctgaagtggggcgagtggctggggcaggcgttcagcggcatttcgctgggatcgatcctgctgctggcagctttggggctggcgatcacctatggcctgctgggggtgatcaatatggcccacggcgagatgctgatgatcggcgcgtactccacctggctggtgcaggatctgttttcgcgcgtggccccggagtggctggcgttctacccgctggcggcgctgccggtggccttcctgatcaccgccgcggtgggcatgatccttgagcgtaccattatccgccatctttatggccgaccgctggaaaccctgctcgccacctgggggatcagcctgatgctgatccagtgcgtgcgcatgctgtttggtacgcaaaatctcgaagtggccaacccggcctggctctccggcggctgggcggtactgccgaatctggtgctgccgtacaaccggctggcggtgatcctctttgtggcgggcgtgctgacccttacctggctgctgcttaacaaaacccgtctcggcatgaacgtgcgggcggtgacgcaaaaccgccgtatggcggactgctgcggcgtgccgaccggacgggtggacatgctggcgttcggtctcggctccggcatcgccggactggggggcgtggccttatcgcagctgggcaacgttggcccggaactggggcagggctacatcatcgactccttcctcgtggtggtcaccggcggcgtcggccagctggcgggcacggtggtggcggcgctggggctgggcgtgctcaacaaagtgctggagccgcagaccggcgcggtgctggcgaaaatcgccattctggtcctgatcgtgctgtttatccagaaacggccgcaggggttatttgcattcaaagggcgggtaattgactgatgagccaaccgataacgctgaccctggcccgacgcgcgccacgtctgaccggcttttttaccgggctgttgttactggcgctgctggcgctgccgtttctggctttgctgcccgccgcacacccgctggcgatctccacttatacgctgacgctgatcggcaagatcctctgctatgcggtggtcgcggtagcgctggatctggtgtggggctacgccgggatgctgtcgctcgggcacgggctgtttttcgccctcggcggctacgccatgggcatgtacctgatgcgccaggccgccggcgacgggctgcctgcttttatgtcgtttctgtcgtggacggagctgccctggttctgggcggggacacaatattttgcctgggcgctgtgcctggtgatcctcgtgccggggctgctggcgctggtgtttggctggttcgccttccgctcgcgcattaaagatgtctacttttcaattatgacccaggcgctgacctatgccggaatgctgctgtttttccgcaacgaaaccggctttggcggcaataatggttttaccggcttcacgaccatgctgggctttccggtctccgccaccggcacgcgcatcgggctgtttatcgccaccgtgctgttactggcgggcacgctgctggtgggcgtgctgttaacccgcagcaagtttggccgcgtgctgacggcggtgcgcgatgcggagaatcgcctgatgttctgcggctacgatccgcgcggctttaagctgttcgtctggacgctgtcggcggtgctgtgcgggctggcgggggcgctgtatgtaccgcaggtgggcattattaatcccggcgaaatgtcgccgaccaactccatcgaagcggcgatctgggtggcgctgggcgggcgcggatcgctgatcggcccgatcctcggcgcggggatcgtcaacggcgcgcgcagctggtttaccgtggccttcccggacttctggctctttttcctcggcctgatgtttattctggtcacgctgtttttgccgcgtggcgtcatcggccttattcaacggaggaagcatgactgatgcgctctttacccagccgctgccgcaggatcgctttcgggaaaccaccgatccggtgttgcagctggaaaaaattaacgtcacctttgacggctttcgggcactgacggatctgtcgctgtccattggcgtcggcgagctgcgctgtgtgatcggccccaacggggcagggaaaaccacgctgatggatgtgatcaccggcaagacgcgaccgcagagcggacaggtgttttacgatcagaccatcagcctgctggaactgtcgccggtggagatcgcccgggcaggcattggccgtaagttccagaaaccgacggtatttgaagcgctgagcgtgctggaaaatctggagatcgcgcagaaaaccgataaatcagtgtggcatagcctgcgggcgaagctgaacggcgagcagcgcgatcgtattgatgaagtgctggaactgctgcgtctgaccgggcagaaacagcgcccggcgggactgctctcacacgggcaaaaacagtttctggagatcggcatgctgctggtgcaggaaccgcatttactgctgctcgatgaacccgccgccggccttacggatgcggaaaccgaatatatcgcgggggtgttccgcaagcttgcgggcaagcattcgctgatggtggtggagcacgatatgggctttgtggaaaccatagccgatcacgtgaccgtgctgcatcaggggcaggtgctggcagaaggctcgctcgcgcaggtgcaggcgaatgagcaggttatcgacgtttatctggggcgctgatcatgttgcaggttaaagagttacagcagtattacggcggcagtcatattctgcgcggcttatcctttgacaccccgcccggcgagatcacctgtttgctggggcgcaacggcgtgggtaaaaccacgctgctgaaatgcctgatggggctgatcccggcgaaatccggcactatccactggcagggcaagctgattaacaatgcgaagccgcaccagcgcgttcagcagggtatcgcctatgtgccgcagggacgggaaatttttccgcgtctgacggtggaggaaaacctgctgatggggctgtcgcgcttttccggccgcgacgcgaaaagcgtgccggaggagatttatgcgctgttcccggtgctgcgggagatgaagcagcggcggggcggtgatctttccggcggtcagcaacagcagctggcgatcggccgggcgctggcgtgccgtccacagctgttgatcctggatgagccgaccgaggggatccagccgtcggtaatcaaggagatcggcgcggtgatccgtggcctggcgaaccggggcgatatggcgatattactggtggagcagttttacgatttcgccgctgagctggcggataattatctggtgatgtcgcgcggggcgattattcaggcagggaaggggcatgagatggaagcgcagggggtacggcatctggtggcgatttagtgttgtggggtggtgcccggcggcgcgttgcttgccgggcctacggtcaatacctgtaggccgggtaagcgccagcgccacccggcacaacagttacatcacaatgtcgcattcccggcatgcatccccggcaccaggatcaccttgcggcactcctcctggcgtttctcgaagatctcatagccacgcgccgcatcttccagcggcatatggtgggtgacgatctcttccggcgtcagatggcctttttcaatcagcgccagcagatccggcaggtacgcatggacatgggtctggcccattttaaaggtcagccctttgtcgaacgcatcgccgaacataaaggcgtgaataaagcccgcatagacgcctggcacgctgagcacgccaccgcgacgtaccgccgcgataccctgacgcagcactttaccgctgctgccttccagcttcaggttgctcagtaccgtttcggtcaggctgcctttggcttcaaagcctacggcgtcgatcactgcatccacgccacgatgacctgcggtgtgctcaatgatgtacgccgccggatcgtcattgtcgtcgaagttgatcggcacaatgccatagcgctgtttggcaaactccagccggtagtcgttatggtcgatcataaagatcagctccgcgcccatcagacgggcacaggcggcactcagtaaaccgaccggacccgcgccgaagatcgccacgctggagccttgcttaatatccgcgtttttcaccgcctgccaggcggtgggcagaatatctgacaggaacagcactttctcatccggcagggtatccggtactttgaacgggccgacgttggctttcggtacgcgcacgtactcagcctgaccgccgggaacgccgccgtaaagtttgctgtaaccaaagagcgcggcgggcggcgtaatggatttacggtttaaggtggcgccgccgccgctgttggtgttttcacacgcggaatactggtgcatatgacagaaaaagcagtcaccgcaggcgatcacaaaggggatcactacgcgatcgcctttcgcgacggcgtgtacatctttccccgtctcgaccacttcccccataaattcatgaccgaaaatatcgccatgatcggtgccggggatcttcccgcgatagaggtgaagatccgaaccgcagatcgcggtggcggtaacgcgcaggataatgtcgtccgccgcttcgatactcggatcgggcatggtatcgacactgactttatgcgggccgtgataggtgagtgctttcattattgtttgctccggtatcgtaatcgcgtgttaaacagaaactacgtcagatcttgccgttacagcgtgccggtaccgccatcggagcaccagacctgacctgagctgtagctgttttcattggaggccagcgtcacataaatagtggcgatttcggcaggctgcccggggcgacccagcggcgctgaggcaccgaactgctccagtttttcctgaggttgaccaccgcaggcctgcaacaccgtccagtatggccctggcgcgaccgcgttcacgcggatgccttcttccgccagttgttgcgccagggatttggtaaaggcggcaatggacgctttagtctgggcatagtccagcagcgtcgggcttggctggtaggcctgtacggacgaggtgttgatgatagacgcgccgcgtggcagataatccagcgccgctttggtgatccagaacatcgcgtagacgttagttttaaaggtggcgtcaaagtcttcggtagacagttcgcggatatggttgcggaactgctgacgaccggcgttattcaccaggagatccagcccgcctaactcttccgccgcctgtttgaccagctgctggcagaaggattcgtcgcgaatatcgcccgggatcgccacggctttacggcctgcggcgcgaataagttcaattacctcgcgggcatcttcttcttccgccggcaggtagttgatggcgacgtctgcgccttcacgggcataggcaatggccaccgcgcggccaataccggaatcgccgccggtgatcagcgcttttctgccttccagacgaccactgcccttataggaggtttcgccgtgatcgggacgcggattcattttacaggccaggccagggaagggttgatgctgacgttcaaacgggggaaccggatagttgtctgccggattggagatacctgcggtggtgacgccgtttttattgctcatgtttcgctccttctgtgtggctttgggtctattaagcatagatcatcagcgtgaaatgccagttttctcggaattttgcacataaaaagttgcttaaaaggcatttgccgcttcgtttagccagcctggaaaaatctgcaattcgcaatgctggcttgcgccatgccgcaaggtgcaaaatacttgaagcattgaaaatcgtttggtttttggttgcagatgtggcaaagcccaccgacaaccgctgaaacgagtgaggatgtggtgacagacacttacaaaaatgcttctggcaacagcacgtctttacctgcgcttgcgcccccgtccggggaagagacgctgggaagggtggtgatggaattgctgcgaggcggacaggaaatcaaccggcatagcctgtgcgtcaaactggccgcgcagattgacctttcaaccgatccggcgctggaagcgcagctgagtgaacttcttggtctggtgctaaataaaagttaaaattcattgtgaatatctatgtccaggccctttctttccgccgctgacgcagccatactcaccgggttacaccgtgcctaacggtaacaataatgagaggctcaatgagcaaaaatgataaggaaagactggtagataccatcatgggggaagcggtgttgcatcttctcgaaaatgatgacaacgtttcctttgatgcgcttatcggccagttacaggaaaatctgcaaaatgaaaccgaccgggaaaggcgcgatgctttccggaccgccattaacggtgttcatcagttccggtcgctgcaaactcaatcggtgagcacgccgggatcgctaaagcagagtttgcgcagttcgctggcgcagaaaagtacttctaccactaaacactaataccactaaacactaatctgtccctctgcttaaccttcgggttagcagagttcgcccttctaatcagacttgctctggcatgcttcatcgatgctcctgtgactttgataatggctccggccatagaagaagacatcccaccccgcattgagagtgcaattgaaagaagatgaacagatttttcttgaaaatattcaagaggctatcggcgaggctgcgactcatcttatgagtaacggtcatgctatagacgccgaaaatatcatcctcgtactgcgcgcacgccgtatgatgacgaccgatccacaccaccagcacgtttttgaaggagcctgtaagttacttaaggttcgggtaaaacaatccgcgtaatctcagaattcacaccggtcagccgtgcgtgtttcacggtagaccgggtggatttttatcaaaacttacaggtcatctggcgtttgctgaacaatcttttccagcgcgctgcgatagacatccagttttacaacatcctcttccgtctcaagtaagcggatcaccgccagaataaggttcttattggtgacctctatctggttacgcttcagacttgccgaaagctcctggatgaacagtctttcggcttcaaacgtctgcgcgctctggccgaagtattcattcaactgttcttctgatgtcgcggtgtgcataaaagatcctcaaaattcataacgttttcctctcaatatggcgagagggtatgagtaaccgaataaaattagtcatcattaagattatccgcaatatggcacgtgcaatttcttcaaaaattttttacgcaaacgttaactattttaagaatgtgcttatcaaatgttaagctcagttctgcaccagcttaatcttctgccagtgcctgtttcagatcttccagcagatctttctcatcttcgatcccaaccgataaccggattaactgcggcgtaatgccattagcgagacgttgcgccagcgggatagaggcgtgggtcataaagaacggctggctcaccaggctttccacgccgccgaggctttctgccagcgtaaagagcgtgagacggctgatgatttgcgcggcacgctgttcatcgcctttcaccacgatggagatcataccgcccggcagcgccatctggcggcgggccagctgatactgcggatgtgattccagccacgggaaaaagacctgttcaacctgcggctgctgttccagccattgcgccagccgcagggcgttgctgctgtgccgctcaatacgcagcgccagagtgcggatgccgcgcagggtgagaaaactgctgaagggatcgagcacgccgccgacggcgttttgcagatagccaagttgttcagccagttcagggcgatcgcccaccaccgccagcccggccaccacgtccgaatgaccgttaaggtatttggtggcggagtgcaccacgatgtcaaaacccagcgccagcggacgatggatcagcggcgaggcaaaggtgttatccgccacgctgatcaggttgtggcgtctggcgatggcggcgatggcttccagatccgccagcttcagcagcgggttggtcggcgtctcgacccagatcatccgtgtgtccgggcggatcgccgcctccagacccgccagatcatccggcttcacccagctcacctgtaagcccgtgctgcggcggcgcacgttttcgattaaacggtaggtgccgccgtaaacatcgtcgatggcgacaatgtggctgtctttgtccagcagctccagcaccgtggaaatggccgccagcccagaggcgaaggcgtagccgcgcgcaccgccttccagttcggcgatggcactctccagcgcgtgacgcgtcgggttgccgctacgggagtattcgtagccggtgtgctgacccggtgcaggctgcgcaaaggtggaggtggcgtaaatcggcggcatcaccgcgccatgctgatcgttaaacgcgccgctgtgcacgctgagggtatttaatgttttcatttttcttccttacaggcattgctgatcagaccctgctcgcgcagccagtcgtcgttaaacatttttgagagatatttgttgccgctgtcgcaggcgaaggtcaccacgcgtttcggcgtggtctgggctgcgcagtaacgcagcgccgccgccagcagcgtaccggtggaggatccggcgagcacgccttcgcgctgtagcagcaggcgcgcggtggcaaaggcgtcggcatcgctgacgcggtacgcctgtttcacgccctcaataagcgcaagcggcggaataaagtcttcgccgatgccttccacccgccatgatcccgcctcgccgtgccgcccgctttccacctggtcggcaagaatggaaccttcgggatccgccagcacaaattcggtatgcggtgagtggcgcgcaaaccaggcttgcaggccgccgagggtgccgccagagccgacgccgacaacaatggcgtccacgcgcccgtcgagctgatcatatatctctttggcggtggcagcgtgggccagcggattggccggattgttaaactggtcgatgtaataggcgccaggcatatcctgcgccagacgcagagcgtaatcctggtaatacgccggatggcctttggtgacgtccgagcgggtgagcaccacctctgcgcccagcgcccgcaggtggaagatcttctcgcggctcattttatccggcaccaccagcagtacccggtagcctttttgcgcggcgatcagcgccagccccagcccggtattaccggcggtggcttcaataatggtgccgcctggcttcagtaagccttcccgctcggcggcttcaatcatcgacagcgccacgcgatctttaatcgacccgccgggattttggttttccagcttcaggtacagctcacagggcccgcgctgcagcttatgcagctggagtagcggcgtatggccgattaattcagtgacagaatgggcaacagacatggtgtgcgatccgtagttaacacgatgcctggataataggtctgcgattttcgcggattaaagaatctttctctgcattttagatcgaaaaggaatatcacctgctgttcagccatcaggaaggaaatccctgtagacatccggacgtgttgattgctataaaacggcacttttgccgtaaaaacaggcgaatggcgcataaattgtccgtgatttatgcgttttttagctaaccaatgctgaaaatatccattacacagccaacccttttgccatactggttatagctaacaggtataagcaatgatgattaagttatttcaattataattgcgacagattattatcgtctggacatccatactgctaaaccgccaaaacggatagaacacatacatgatcgtccttcggaatatttccaagatttttgaccacggaaaggtgcctatcaccgccgtggatagcgttaacctgacggtggagcagggacaaatttacggcattatcggctacagcggcgcaggaaaaagcacgctgatccgtctgcttaacggtctggaaaaaccgacctccggggatgtcaccatcaacgggcagaatatttccagcgccgagggcgaagcgttgcgccaggcgcgtctgaagatcagcatggtctttcagcactttaacctgctgtggtcgcgcaccgtcagcgagaacatcgccttttcgatgcagatcgccggtgtgccgaaagcgaaaatcgccgcccgcgtggcggagctgattgagctggtgggcctgaccggacgcgaaaaagcctacccgtcgcagctcagcggcggccagaaacagcgcgtcggtattgcccgcgcgctggccaacagcccggacgtgctgctgtgtgacgaagccacctcggcgctcgatccgcagaccaccgatcaaattctcgatctgctgctggatattaaccgccgctttaagctgaccattgtgctgatcacccatgagatgcacgtggtgcgcaagatctgcgatcgcgtggcggtaatggaaaacggcaaagtggtggaagagggcgatgtgcttcaggtgtttacccatccgcaacagccgatcacccgtcagtttgtgcgccaggtgagccagtatgcggaggaagaggcctttaacccggcgctggcttccggtcttgatggcagcattatcaaactgacctttaccggcaataaaacctatcaaccggtggtcagtgaactgacgctgcgctacggcctgtcgtttaatattctgcacggcaaaatgacgcaaaccgcacatggcctgtttggtcagctgtgggtacatgtggtggcaaatcaggaacaactgaacaatatccttgccgatctgcaacagagtgatattgaaggcgaggtaattaagcatgattgagaatttactgccccacctgaaatgggaccagctgtgggcggcgacgctcgaaaccttatatatgacggcgctgtccggcgtggcgacctttgcgctcggcctgctactggggctggcgctgttcctgaccgccaaaggcggcctgttccagaataagccgctgtacagcgtgatttcggtggtggtgaacgtgttccgttccatcccgttcatcattttgattgtgttactgatccccttcaccaagacgattgtcggcaccattctcggcgcggatgcggcactgccggcgctgattgtcggcgcggcgcctttttatgcccgcctggtggaaattgcactgcgtgaagtggataaaggggtgattgaagcgacgcgttcaatgggcgcgcgcctcagcaccctcgtattccgggtattaatccctgaatcctcgcctgcgctggtgtccggtattaccgtcacgctgatcgcgctggtgagctatagcgccatggcaggtgttatcggtgccggtggcttaggaaatcttgcatatctggaaggattccagcgtaaccataacgacgtcacgctggtggcgacagtaaccattctggtgattgtcttcatcattcagttctgcggcgacgtgttgacctctctgttagataaacgctaaacataacaattactggaaaccaacatcatgaaaaagacactgacactgattgccgcagccaccctgagcgccctgagctttgcttcctgggccgataccctgaccgtgggcgcatccaacgtgccgcacgcggaaattctggagcaggcgaagccgatcctcgccaaagagggtatcgatctggaaatccgtccgttccaggactacatcctgccgaacaccgcgctggcaagccgcgacatcgacgccaactatttccagcacatcccgtatctgaacagcgtgctgaaagatcatgcggatgacaaaacctatgatttcgtcaatgcgggcgcgatccacattgagccaattggtatctactccaaaaaatacaaatcgctgaaagatctgccggaaggcggcaaagtcatcatgcgtgacgcggtggcggaagagggtcgtattctctctatcttcgagaaagagggtgtgatcaaactgaagccgggcatcgacaaagtgaccgcccgcatcagcgacatcgtggaaaacccgaaaaagctgaagttcctgccgaacgtcgaaggttctctgctgccgcagatgtataacaacgacgaaggcgacgcagtggtaattaacgccaactatgccatcgatgctggcctggatccggtgaaagatccgattgccgtggaaagcggcgaaaacaacccgtacgccaatatcatcactgtgcatcgcggcgatgagaagaaaaaagagatcgtcgagctggtgaaagtgctgcactcgaaagaaattcaggagtggatccgcaccaaatacaaaggcgcggtgatcccggttaacaactaaccctgccccttcacgcgtcagctgccgctggcgcgtgtttccctcatcctgccgtatgaaattcctctgtgatagtagtcaccaatcctaaacaattaagaaaatagttaataacaatcctctactattgccgggacaagctaagcagaggtagagatgaaagatgtcgtgatcgtaggggccgtgcgcacgcctatcggctgttttcagggcgctttatctcgtcattctgcggtggaactcggcagtctggtggtcaaagcgcttatcgaacgcagtggcgtgatcccgcaacatatagatgaagtgatcctcggacaggtattaaccgccggtgccgggcaaaaccctgcccgccagacggcgatcaagggcgggctaccgaattcggtgtcggccatcaccattaatgatgtctgcggatccgggctgaaagcgctgcatctggcgacacaggcgatccagtgcggcgaggcggatatcgtcatcgcgggcggccaggagaacatgagccgtgcgccacacgtgctgacggacagccgcaccggtgcgccgcttggcaacagccagctgatcgacagcctggtgcatgacggcctgtgggacgcctttaatgattatcatatgggcgtgacggcggagaatctggcgcgggagtacggcatcagccgtgagcgccaggatgattacgccttacgctcccagcaaaaagcccgcgccgcgatagacgcggggcgctttcgcgacgaaatcgtgccggtgctggtggatcgccccggcgggcagacgctgcgggtggagtgcgacgagcagccgcgcaccgacgccagcgccgaagggctggcggggctcagcccggtctttgatcgcagcggatcggtgacggcgggcaatgcgtcatccattaacgacggcgcggcggcggtgctgatgatgagcgaaagcaaggcgctggaacttaacctgccgatcatggcgcgcatccgggcttttgccagcgtcggagtggatccggcgctgatgggcattgcgccggtatatgccacacggcgctgccttgagcgcgcgggatggcagctacaggatgtcgatctgatcgaggccaacgaagcctttgcggcgcaggcgctgtcggtcgggcagatcctggaatgggacgagcggcgggtaaacgttaacggcggggccattgcgctggggcatccgattggcgcgtccggctgccgtattctggtgtcgttggtgcatgaaatggtgaaacggcgggcgcacaagggcctggcgacgctgtgcattggcggcgggcagggcgtggcgctggcgatcgagcgcgactgattttgtcttgtgtgccgggcggcgctgcgcttgcccggcctgggtttatggctgttttgccgggcggcgctacgcttgcccggcctacgtttgtggtgttgggtctctgtgtaggcccggcaagcttgcgccgccgggcgtgccagactcctcctctcaactccccctcccgataaacatcaataagctaatccttactgttttaaattttttgaaattgaaatttctgtctgcaaattaaccctgatgccatgggtaatgaataattataaatttaatgatgactaaaaaataaagtcacaacaggtactatatgtctgctaatccactatcatgctgataaatatggtttttcattttttatgaaatctttgttgttactaagttaataatatatttatgtgatcgcagtctttatttaatgccattatcacaaattattattgatgctcatcacgtcttcccgctctgcttttcagcaagcaaataattacgatccggatcactaaaaaatcctttttaaaaaaataaaatgcagtctcataaaaacggaacgatattttaaatttttgagggttttttcatggttaaaaagtctctggtccttgcgtctctcattggtgcatcatttgcggcccaggccgtaaccgttgacctgcgtcacgaatatattgacagtggcagcaacgccgaccgtgtttctgtatcccaccgttttgataatggcatcggttttggtgtggaagcaaaatggaaatcaggcggtgaagatgcagataaaccattaaccgaaattgtaggtaatggccatgaagaatccattaactggcgctggaaggcgacagataattttgcgctgacgccaggttttaatattgaaagtaaagacaccttctccatttataagccgtatctgcatgcgcaatatacctttgacagcggcttttatgtagcgggtcgttaccgctatgagtacacccgtaaccctgactcagatgtggttgataacaaagtaaataaattcgacgcctgggtgggctgggcgatgggcgactggcgtaccgagctgaactacgtctatgccaaaagcaccgaagacgtggttcgtgaaaatggtaaaaactactccaacgaatataacgccaagctggcttacaaatgggataaaaactggtcgccgtatgttgagctgggtaacgttggcgtgagaaataccgatgagcgtcagacccgttatcgtgtaggcgtcgcatactccttctgatataaaacttaccctcatgagatgccccggcgcagttagtcggggttttctcgtttttgttatttatggcactggcagataatctaataaaataataatcagcggatctaaaggctattataaataaaaaaaggccctccagaaggagggcaaggccagttacagaaacactaactcaattacgcttgcaacatttcacgctgctcaggaagcttcgcaatataaagggctggtttgccgtctttatcggagctaaacaggatcgcactatcgtccggcgtaaaggacgggtgcgggtgagtcacctgacgactattttcgaaggtggcccatgaggtatcgtgacgcgccacgcggaaatacgcgcgctgcgccacatcaaagacataaagataaggatcgttatcgatggtgtagccgccggtgtcttttacatcaaccggcgtgccggaaccatcgccgaccagcagcgtgccgtcgaagttgctcatcagatgtgaacaggcaggcatctgcatgacgtcttcattcacaccggtgtccggattaaaacgggagatcgtgcggccctgttgtcctttcagataagagacgtacaccagcgcagaaccgtccggcacccagaactcatgggtgcagctttcgccttcggcgtgatctttcactttgcgcacattgctgccgtcttcattaaccagccacatgcgggcgtcgatcagatcgtgcgggccttcgtgacagaacgccacggtgttgtcatcgaatggacggtaaatcgggtggccgagccagattttctcatcgtggatcactgagctttcgccgctctgcaaatcaattcgcatcaggcggcaatggggacctttatggaagaagtcgtgaaacagctgccagtcggtaagcggcgtccagtcgcttttcgcgatctcaatgcccaccagtttggtgcagtcgctgttggcaacccaggtgccgtaacctacccagtcatcggacacgcggtagacttcgcgctcttcaaaggtggtaaggttgacttcgcgcagagtgcgatcgttcttcacgtaataaagggaacgatcgtctggggaaaggaaaccgccgaacgtattgtcgccgctgccttccgtcagctgtacggcttcggccttttcaatattcagcaagtagtagttccagtgcccgtcaaattcaccggcgaaaagcagatgactgccatcgttgaaaaaacacttctgatagaagtagttacgatggcaggtgacttctggtggggttaagcgggtgatctccgcacccgtatcggggtcacggctgacctcatactgaagttttacccgcatgcctttcgccataatgcgctccttttcctggtccggttgtagggcggtgtcccaaagagttgatgagtttaaaagctgggtgttaatttatcaaaacgacgtttcaatgtgtgtgacaggtggcgcactttatgaggatctccttaatttattttacataacgacgtctggccccggtgcagaagctctgggatcttcgtttttcaacaataaaactcactcaaaatgggtaaatttaaaggtattttaagtgtttgttttaagtgatttttattcgagagaaaaacgccagagataatcccgtcgtgttgtcaactgcgtacaatcgtgatcctctttacacttttactatttaattacagaaaaagtgaaacgttgttttatttagaattgaaaacgcgttttaagcgggatactatgtgcccatactgcaagcggaacactgttttaatgcttcgctgcatgacatctcagtcagtttctttggaggttaatgtggaagtcagacaaagcatccacagcgcgcatgcaaaaacactggatacccaggggctgcgcgatgagtttttagttgagaaagtgttcgtcgcggatgaatacaccatggtgtacagccatattgaccgcatcattgtcggcggcattatgccagcgaccaaaaccgtgtctgtgggcggcgaagtgggcaaacagctcggcgtgagctacttccttgagcgccgtgaactgggcgtgatcaacatcggcggcgcgggcagcattactgttgacggtcaggtttatgaaatcggccatcgcgatgcgttgtacgtcggtaaaggcgctaaagaagtggtgtttgccagccgcgatgcggcgaacccggcgaagttttactacaactgcgccccggcccataccacctatccgaccaaaaaagtgacgccatctgaagtatcgccggtgacgctgggcgatccgctgaccagtaaccgtcgcaccatcaataaatattttgtccctgatgtgctggaaacttgccagctcagcatgggcctgaccgagcttgagccgggcaacctgtggaacaccatgccgtgtcatacccatgagcgccgcatggaagtctacttctacttcaacatggacgaagacgcctgcgtgttccacatgatggggcagccgcaggaaacgcgtcacattgtgatgcacaacgagcaagcggtgatctctccgagctggtctattcactcaggcgtgggaacgcgcgcttatacctttatctggggtatggtcggcgaaaaccaggtctttgatgatatggaccacgtcgccgttaaggatctgcgctagtcgcggacagcataagttaactctgcctgttcgtgcaggcgctgcaagattaaggaacaaacatgattctggatgcattttctcttcaaggtaaagtggccgttgtctccggttgtgacactggtctgggtcagggtatggcgctgggcctggcggaagcgggctgcgacatcgtgggcatcaacattgttgagccgacagaaaccatcgaacgcgtaaccgcgctgggccgccgttttctgagcctgaccgccgatctgcgtcagattgacggtattccggaactgctggagcgtgcggtctccgaattcggccatatcgatattctggtgaacaacgcgggtcttattcgccgtgaagatgcgattaacttcagcgaaaaagactgggacgacgtcatgaacctgaacatcaagagcgtattctttatgtctcaggccgcggcgaaacactttatcgcgcagggtaaaggcggcaagatcatcaacatcgcttccatgctttctttccagggcggcatccgcgtaccgtcttacaccgcatcgaaaagcgcggtgatgggcgtgacccgtctgctggcgaacgagtgggcgcagcacaacatcaacgttaacgcgattgcgccgggctatatggcgaccaacaacacccagcaactgcgtgccgacgaagagcgtagcgccgcaattcttgagcgtatcccggcgggtcgttgggggctgccgagcgatctgatggggccggtggtgttcctggcctccagcgcgtctgattatattaatggatataccgtggccgttgacggcggctggctggcccgttaattaatcatattcttaaatgattacgccctgcccgaagcagggcttttttatgcctgaaataaagtaacttccaataaaatattaaaaaactttatattttatttctgcattatgatttttgtgagacatctcatttaatatataattgatatgaattacgctaatgattaatgaaaaaatgagatattgatttgctgattgctttgtttaacttgttgatttttagtggttaatatttcttttctgaagggtatttaacctaattttttataatgttgttaaagtgcaacatttttatctctcatccgaccatcgtgtcattatcctatttcatgctgcagatatcatgtcactgtggcattcgaaaaataaatattcttataatgacgcgcctctattgcatgaggggcagtcaattcaacaaggattttttcaaacataaggaccaggaaatgagaacgttaattgattcatggaagaaaaaagcgaatcggtatcaggagctcaaaaaacagaagggtgtgaccttactggaaatcatcattgtactgggtattatcggtattattgcggcgggtgtggtagtactggcacagcgtgcgtttacgtctcaggatatttcaaacgttattgatgataccaactcagttcgtgtcgctatgaccgaagcgtataaagacagcatggaatatccagcgcttgtatctgtaattgatatcaccaaagctgatattgccaaatcaagcagtaaggctgccatcgtatctctggttaaaatgggcaagatcagtcccgacgaagcatttaatggtttctccaatgatgcgttcgaaattggtcacgctaaactggggacaagcgatgcaaaatttaagggtttctatttagtcctgaatggcctggaaactgaagattgccgcaatgttatctcacaagttggtgctcagtgggactatgtcgccacgactactggtcgtgcaggggaaaatagtggtcaaaatgatgaattagatatgagcgttcctgttacaactgctggcgtattgaaatctactactggggaccgtctgaaccctgaagaaattgttgcgaaaggtatctgtgatgctgatgccggtgcgggtaacgcgatcgtactcggcagtcgttaattaaccaagcattaataatactaatatttcatgccctctgatcctcagggggcatctttgtcagaatggatgcatgacatgacgaacaggcagaataataaaccgggtcgtgcggatgcaggcgtcacattattagaaatgataattgtgcttgccgttattggcgtggccttgatgatgctcgccaattataaacgaaaagaagcacagcaaacgcatcagcaagttatcgctgagatgatcgtgcgcgatatttctggcgtgcttaagttcaccgcgcaaaccaagctggatattcttgatagcggcaataatcctgcgacgaaagacaatcccctgtacgatgataaaaacccggataaggctaattataataatcgggtagaaaataagaccctacaggatcagcctgatactgaagaaaaaaatttttattctgcctggtccagggatccagaaaaagtcagccaggtgtcaacggttaatggttcccgttacctcttcctcggcagtgaatgccgcggtcccagtggcgcaaaaggcgcattaaaattcaagcttgcagacaccatgctcccatgtgaaatgcgtgcaggtgcagaagatttcgaactggtgctggagcgcgtggattttgttaacaacagcggtagcactggcgctctcggtattcagcgcatcgatttttacctgacgcatcaggcagaagccgaggatgagggactgcattttaccggctttattaaaccgctggaaaaagcgctgcgtaatgcgggcctgggctatattcaggcggcagtcgtagagatcacttcttccggcgattttaagctgattatgaagaattcgaaggtgattgaggtcagtgatgttgccagtaatatggatctctttgataccgataaacgctacggtatccgcctgagcttcgataaaagcagcgagtatattccggctgacggctcggtgcctgtcgccaaaatgtgctggaatgatgtaaaaggtgaagccgggccctgcatttccgccattgattccgatcgcctggtgatcaaaaccagtgatgcagcgggcaaaaacagcgatgaaccggcgatgtgctgggataaagaacagaaacagagcaccctgtgcctggcagcgatgaatagtaccggcgttaatccaaacggtgagaatccggacgatcgcatcctgcatttacgcaccacttcaagtaaaaatgatactgaagtagtgccgggaacgccgagttcactcaagggtactaccggtacgctgtatgccaatatcgtgatggaaaacacttcccggcggcacccggcgatatggcatatcgcctataaccaggatgatgctaataagctgaaagatggcattggtggaagtaaaaataccagtgacaacgatagtaccactttagattttaaggatgccttccggggccagtatgaactggtcacgccagccgtcaccttctaccagtcatttaaaaatgattatgcgccaggagccggaccgaaaacgaatattgatcaactgtatatagataccaacgccgagaagaactataaggcgctattatcagaacccggtgtgatcaggttgccactacaaacctgcccgcgagtggatggcaagccatctaacgcagaaagcaaatcagcgaatgccccattgctggcccgtaaactctatccacgcttgtcggtcgccatttcatcagtagcggcagacgataataaagagatggatgagcgtgggtataccgactatacccagcagggcgcggtgcgagctaatacgaacgcaaaaggcaatccggcaggagcgatagccggtgtcgcggttcaggcaaatatcgtagtagataaagacgatgccactgaagctgacagggcgcttctgaaagaagaaacaacaggtctttttgacgactggatttctgatatttggtttagcggaaaggatatttaccataaaccattttggttaatcagcgcgaccgcagcaactatcgatccggatggtaatggtaccaataaaatcaacccgcagtcattgtcggtcattattacccagtggtgcagcactatcccgcagggtgggattatatcttctgatgcagcatataactgggatagcaaagaaccgcataaatttttattgcactctgtcgtagcagaagatacagatttgaagttctacaacgacagtgatagtgaaatcgattttcctgaccatgaaagaattacctattaatcattggaagaataaaatgaaaaaaacatggattattaaggccgcggtaactgccgtaataggggggcagatcgcctttgcgggtgccgcaaccgcatcaaagaatgccgacgcgggcctgctggtcacaacaccacagcctgctcagccgacagcacgtaacccgttttccggcagtgaagcggtgggcgttaccgcgccagtcagcaaacccgttgtcgtaccggcgccggaagtaaaactggtgctggttgaagaggaattgctcagccagcaactgtcgaaatgggcgcagcaaaatggctataagctgctgtggaacagttccacagattttgtcatttataaagcaatcaacctttccgggaagacgacacaggatgtattagtgaagctgggaaaggtttttacctctgagaattatggcttagtgatcaaagactatcaggccaaccacgtactgatcattgatgaacagtaataaacgcaagggaatgatgctatgaatattaaagtttcgcttctggcactgacgctggccattcagggctgtacgtcttttgatacgaaatacaataaagataatgttttaaaagagacgggtaatccaactacaccggatgagatgaaaaccaccggctacatgaaatataatgaaccctatctgggtaaaaaagtggaatttaactcccgcaaacagtccctgctgcgcaagcatgtaaaaattcagtcgtatgaagcgaccgatttagccaccattctggaggcggtttcggcgcagaccggcgtcagctatcgcattaataccaaagccggtgaaaaggcagaggcgggcgagccagaataccgcagcgtcaactttgaaggcacctttgaggagtttacccgctatatttccgcgctatatgacgtcaatccggtgctggataacaacggcgtgctggtggtttcttactaccaaaactatgtgctgaagctcgatttctacggcgaagagaataagtttgaaaccagtctcgatctgtccggcaacgaggccacctcaagcggcggcgtgaagggcaaagcggaaaccaagttcgagtccagcttctgggacgacgtggaagacatggcggagaaattcgtcagcagcggcatgtacagtatctttaaagatgcttcgatcctgactatcacggcgcgtccgtctgaatatcacgcccttaatgaggcgctgaaaaaattccaggccgacaatacgcgtcagtttgtggttacctacaaaattttcaccctcgataagcgtaaagcgaaagagctgggcggcggcattaacggcaaatttaatgacggcacgtcctcattcggtattgaaagtgccgatatgctgatgaaactttccggcggcatgtccgcaggctggacgaatcagcatatgaacatcagcgcacagctggatgcgctgtatgaattaaccggcagtaaggtattgcagagcggctcttttattacgcgcaacaatattccggtaccggtcaacatgaccaattcacaaaattatgtttccagtcgtactcgcgaagaagactcggaaacgggcgatgtggacatgacggttgagacatccgaactcatcaccggtaccagctttattctgacaccacgtgtgttaacggacggtcgtattgaggtggccagcgcctttaccaagcgttacctgcagggcattgaagttttcgatgacgtgcagttaccagctgtcagcaccactgaaacctttaatatttctaccattacgccgggaagtttattactggtcagtaaatacgaagccagagaggatgcagacagccgcggcatatccattctggaagggtcggtcactaacgatgaacataccgaaacggtagtgatggttgtcggtatcgatcattatcgcgctcctacacaaacccggtgaggcgtttatgcttgagcgtttggcagagaataacgtcctgatcaatctggtctggaattatcaaccggcgtcacatgaaccctattatctggaatgggtggcgcatttacgccgcacgcaccgacagctgaaaacggtcgatgacaacggtcaggaaatgacggcattttgtcacaaactctctacgttgtatgagccgtttgcgctgtggatgcgtgcgttgtacggggatgggatcttttactgtgaaactcaggggaattattactttctgattatttcgcagggtgcccccgtctcgggtagcgatattgtcgtgtcacggcggttctggacgatcctgaaagagcaactggctgaatcgcctgagtataaagatctcgcgctcaggaaaatcaccgaagagcatatttcaacggtgatcgaacgctgcaacgaacatcaggcgaaaatgaaaaaaaggcgtcaggtcattattggctcgctggcgttgggcggcattgttttacttttggccgtgatggtgctgctaaaaatatttataagaggataagcaggtggctgagtccaataaattatatttctggaaaagtcgtagtctcaacgtctcgtcgtcaggaaagggcacgtctgttctcgtctgggttattgtcgtgctgttactgctggtcgccgtgggaggcggagcctattactacctcgtctggaaacctgagcaggagcgtctggcgcagattgaaagagaaaaagcggcacgccagcaaaaaataaaatcggtggagaagttttatcaggactcgctcaccggcggcagcattacagatgtccataagctgttagcgcaactccatatggtgaatgatcgtctggcgatgctgggctttagccctaaagcgatgctttgtaatagtaaggattgttcccttagctatcaacttaacgccggaagaatattcactatgaccgatattcaggtggggggagagagttattcaccgagcttctcgcaaaacagtctggattatacgggcataccttctggtctgaataatcacccgtggttaaacgactggaaaaataaaaagccagtggatctgccggtatgtactgatgttttaagctacctgagtacctggaattcccttggcggcagctataacgaaatcgctctgaaaggttttccggcgtcttcggtggcaaatgatgaatccgcgctgaaaaatgcggtgatgtcatttggcatgctattcgctaactggacgatcaccataccgtctgaaatggcgatgacgaaagtatcgctattgttacaaaaacagctatttgccgatgcattcattattaaatctatagagttcaaagaaaaatcaacgcttgttaccggaggactggcatgcaaaaagggaaattaattattgcggggttgatgttgacgctgtcgcctgcgatctatgcggcagagacggcggaagtaaaacctgctgagcagattgtagaagggcaagctgcggcaacagccgaaagcgcggcttcgccgatgcaaaatcatgtcgtccagttgatggagaaggatttcagcttcgaaacgcagtatcgggaactgaataaccagctcgcgctggaaaaactgcgtagcgaactgcgtaaacttcgcggcggcaacgccgcctctgttccggtgcctgcaacgcctcttaccgcagcggaaactgattttaacgatgaacccgccgaagccggtgcggctgcgcctgccttacgggcgctactgatctctgaaattgccgggcaaaaacgcgtcgcaatttcaggtgaaggcggcggggtaaaaatggtgccactgaataaacgctttagttacggcggttatgaatatattgctcatcatcgtcagggcgatgaagtcacggttgaggttattagtcagtgatagattatatccagtttaccgaggagaatattcattctcaggagtggcaatttaaagagtatgacggcgatatgctggttgctgaacatgcggatgaagcctggttgctggtatcgacaccacttattgataatcttgctccaatgcaggcggtatttcaccgcctgctggtgacgcataatttgcagattaagggcattgcccaggttacggaacgcaattattaccagattgttgagcagctcctctccacagaaaacaagctgctggagcaggagtccagtaatacgcagcgcgcgctggaagagttactgaaaaaagccgtagcactaaaggcgagcgatctgcatatcacgcgtaacgatatggtggcggatattgaactgcgaattaacggcgttctctgtccatttatccagatgaaagcgtcacgctgcgacgaactggtcttcgtgctttataacgttgaggccagtacgcgtgacacgacctggaaccgcaatattgcccagaatgcgaatattctctattcgctggatggtaaaagctaccgcttccgttatgcgcattatccggtatttggtgaaaccagcgactgctatcacgctgtgttgcgtattattccgtcgggcctggataaagccagcgtcgccagtctggataagctgggcgtctcggatgaagagatcgtcgatcttaaacgcattctcagcaatccgtacggcgcttatatcattgccgggacaaccggttccggtaaatcgacgacgctgaaaaacctgatggaatggatgcaaatccaccgttatgacaatcgcggttgtttcctcaccgttgaagatccggtggaataccagatctacggcgcgaaacagagttcggtattaagcggcgagtctggcggttttcactcggcaattaaatcttcattacgtcgcgatccggatgtgctgatggtgggggagatccgcgacagtatttcatcaaacgcgctggccggtgcggtagagagcggtcactactgttttaccacggtacacgccgggaacattgtgtcgctgttgcagcgtctttcagcgctggggatcaccagcgataaactctcgacgccgggttttatcgcggggctgcaatgccagaaactgatcccgctactgtgcccgcactgcaaggtgcccctgcgtaccgacgttatttccggacgcgaattcccgctgtttgaaaagaatgcggcgggatgcccggcctgtaagcataccggtatcagcgggcggcaactggtgatggagtacctgctgccggtgtacgacgaactggaagccattgccgaacaaaaatggctcaaggtgtacaccatctggcgtgccaagcgttttaaaaccaccagcctcagtgaaggatttgagattaaagaaaaaaccatggcggcggtgctgaccggacgggtctgcgccacatggtttcaaatggaatttggcggagttgctcaggaagaactggaggttatagttgaaaaaattcggtaagaagcaacgtatttacctctaccagttttgtgccgacatgatagaagcggagctgccgctttatgatgcgttacaaaaactgcgcgcagagggcaagcagttacttggaaatggctttgcaaagcgactggaagcgctcaccacaaagatggcgaacaccacctcgatttccatggtatttgaaggttttgtgccggattcggaactgagcgtgattaacgcagcagaacgcagcagcagtctggcagatggttttaagacgctggttaacgtcattaaatacaacagcgagctcaaacagaaaatcgtcggcgcggtgacgtttccgctcattatgctggtgctgtcgctgattgtgattgccggttacgccgccaaagttttcccggcctttgaaagcgtggtgccggtttctaaatggcccggcgtcacccaggcgctgtacacctttggtatggcgttatgtaatggtctgtggatctatattctgtgtggatttatcgcgaccgtgatcgtcattaatatcgcgatgtccaaagtagccggtccgctgcgtaataaatatctcgatcgtattattccgttttcgacctataagcagctttccgcctcgatatttcttaacaacctggcgctgatgctgcgcaataaaattccgctgcatgatgcgttaagtattatcggtctgaacgctaaccgctggctgcgctggcacctgaatgatatgcaggaaaaaatggctaagggcatgagctacggcgaagcgctgaattctggcctgcttaacgccgaagctttgctgaatatcagcctgtacgccgcgctgccttcttttaatgaagtgctgatggcggtgtcagataagtcccgcgaaagtattcgtgtctatatcgggaaactttcaggcttgctgaaatcactttctacgctggtgctgggcggttgcgtaatttgggtctttgccgcgctctttgcgctgagtgacaaactggctgcgatgggtgccagcggttcgttttaagcaggaaaaaggaacgaaaagacatggaactgttgctgccctggctgccggggctctttttactgctggggctgttgtttggcagtctggcgaacgtcattatttaccgtctgccgctaatgatgggcatccacgagaatggcgatgacgccggggttaatctctggtggccgccgtcccactgcccgtcgtgtaaaagcgatattaaaccccgggataatattcccgtcctgagttggctgctgctgcgcggaaaatgtcgacgctgcgccgctgccatcccggcgatttatccgctttccgaactggcgatggggctggtgtggggggcgctggccttctttggcgcgccactctcgcctgtgatcctgctggcctgggcgctgctgtttctgctgctctataccgctgcggtgattgattttaaacacctgctcctgccggatgcgctggtgtttagcgtgctgtggggcggactgctgctcagcgtggcgggctattcctttattcgccccaaagacgccgtctatggcgtggtgctggcgtggctgctgctgtggtgcgtgatgaagttgtggtgcgccttctgcaaatacgagggccttggcaacggcgatgtgaagcttttcgcggcggcgggcgcctggcttggctggcagcggctgcctgagctgttgctctactcggcgctgctgggcctgctctgttatgcggcgatctatttcgttacccgtggcgacggcgataaacgacctgtctacattccttttggcccggcgattgcgcttaccgcctttacgctcgtcattatcgggaggtagccagtgccctgtttgatctggagcctgtggctcagcatcgcgccgttatccatcggcagctgcgatcagcagcaggccaccactgctttcacgcctttgttacagcaggcgctgccgcagtccgatacggcagcgccttccagtagcataatcaccgatgaggtgcgctttgtgcaccccatagagaaaaaggtggcagtcagctccgcttttggcctgcgccgccacccgattctggggcgttatatcgaacataaagggatggatctgccggtgccgatcggcagcccggtgatgtcggtggcggatggcgtggtggtggagcgtgggcacgatcgccgcgccgggaactatctcaccgtgcggcacaatgacggctggtacagccgctatttacatctcaatacggtgactgtgcgtaaaggcgatcgcttgtctgccggggaaaccattgccacctccggtaacaccgggttatccaccgggccgcatctgcatctggagattggctataaaggcgtcgcgcttgatccagcgccgctgctcagcggcagcccgatgctgctggcaagccgcatgcggcacgaaatgccttccgcaaccgtcccggcatcgccgcgagtggtaatgatttcgcagggggagggcgggacgcgcgttaccgtccgctttaaccataaaacccgcaccgtcacgcccggcagtaaggtgttcggcgcgtatcgggtcgttcaacagcacaatggcaaatatcaggttgtttccgcggcctgatgaaggagttatttatgaaaaagacaggaatcgtcgttggcctgcttaccgccatcatattaagtagcagcgcgatggcggccgatgaacccaatgctggtcgttttagttttcagaagcgtacgcccgagcctaaagaccattttatcacgctcaaaatccagatggttggaagaatgcctaatgattccggcggtaatcaggtgctgggcgttaatgtttactggaaaacaaaggataaaaatcagctacagggaaggagcgtttattcatcgctacagcccaatttaccgcgggctggcaagaatttttctgatacttattatgtcgctcataataggcatgagtatgaaggtaaccacgaaaatatcgagtggctggtctgggaaggcgtgaacatggattgggattttgataacggctgccctcctacgcccggcaatagttctacccggttttacaatcatcgtttcaaaacttatgaaatcacaggcgtggtcccggccacctgttcggctgacgctgtggtgagtcccccgcagggtgaagatttggatgttgcattaacctcgtttgcggtgtcatttaatagcggaatctgtaaccgcatgggcgagttttgtatcggtgcaaaaagcggctcaagtaccactttcgcaaaagatatttatatcccttcgtataagctggaattccttgtgattgaagttattggctttgaatacaataccaatacggggggcgccaatcagtcgttttatattctgcccatagaggcgctgaaatttacccccacaggcgagccgggtaatccgggaagaatgaatttactgaggggcgatcgtagtccggcagggggcgaattttcagcatttggtgtgtccggatatacgcagggcggcgaaggcgaaataaggggctattacaacgcacaggacagccatttctaccagaatgacgaaagaacggcagcctgtggtcagttaagcacttctccctgtacttacgatttctctaatctggatacattgattcttagcctggagtatacaaatccacataagatccccaaatgggaacaaccttttggaagtggcgtcatatttaccctcgaacccaggagttttacctggcattgcatggaagaacgcagccagtgtactttccctcctcgtaagtaataaaaaaaggcagcgtcagacgctgccctttttctttcccggtaagagcgattaacgcatcgcgcgtttcagaatacgttctgcctgacgctggaagtcagcggcggtttcttccacgcttttctggccgtagtcgatatactgcaatgcggtcccgaactgtgccacgatctgcggatcgtcaaagtatggcgataccgtcagtttcgatggcagagactgcgccaggcgcagacccgcaaccgccggatcttcttctttaatcgcgccgctggcggtcagggtttccaccgccgctttactcagcggtacaccgcgctccagaccgagggtttccgcgccttctttgctgttcagcaggaagttaatcagctcggctgcttctttcggatgcttagtggatttaccgatagagagcatttgcgccggtttaaagaacaggcctgcgtcggtggcgccgtccagcatcggatagctgcccagttccagcttcgccggtggcttcaggttgtcggagtatttggtgatggtggagttccacatataggtgccgccccattccccttcgatccagggtttcatctcatacatgttgctcttcccgaaggacgcatagtacttggtgtccggcatcacgtggctgtcgaccaggttcttataggtctggaagaactccacccactgctctttgctgtaggcgaattttttggttttctcgtctaccgccggaatgttgtatttctggatcatgtacgagttcagcagcgccagcgtatcctggtgctcaagcaccaccgggtaatactgtttacccagcttgctttcaaaggttttgcccgcggctttcagctcgtcccaggttttcgggtaggcgacacccgcttttttccaggtctcatcgttgaaatagaagacgcgcgccgtgacggagatcggaatgccattcagcttgccgttaacggtggtgcttttcagctctttcggatcgaactggcttaagtcaataacgtctttcacctggttcagatcgtagaagccgtcaccggttttggaaaaaatcggcagccagttccagttagtctgcatcacgtcaggctcggtgccgccggcgatctgggtggtcaggcgggagaggtgaccatcccagccggtgtactcagatttcacattgatgttcgggtgcagcttgtgaaactcttcaatcgctttcagggtgacctggtggcgaccattgccgccccaccaggacatacgcagatccacattgtccgcggcgtaagaaggtaaggcacagagtcccagagtggcggagatcgctgcgcttaaaagcacttttttcatttttatgctccagtttagagagagatgttctgttcggttttcgcgtcaaaaatatgacacttatccatgtcaaacttgaagtacaccttacgatgtaaacctttcgctatcatcggtttggctacatcagaaggaatgcgggcggtcagttcatagttaccaacgcgcaggtaaacaaagaattcatgacccatgttttccacgcgcaccagatcccctgaaccgtaaccttcggcaaaaggctcgtcggagacggagacaaattccgggcgcacgccaaagaagacgtcctgatcctgataattggccactttttcgcgctgtttcgcgttcaggggcagcgtttcgtcgccaacggtgatgtgcagatcttcaccttttctgacgatttttcccggtttgatgttcatctctggcgcgccgataaagcccgccacgaacatgtttttcgggaagtggtagaggttatccggcgtatccacctgcatgatgtgaccgagcttcatcacgcagatgcggtcgcccatggtcatcgcttcggtttgatcgtgcgtcacgtagaccgtggtggccggtttgccggactgtttcagctgtttgtgcagatccgaaatacggatgcgcatcgaggcgcgcagcttggcgtcgaggttggaaagcggttcgtcaaacaggaaaacgtccggctttttcacaatcgcgcggcctaccgccacacgctgcgcctgaccgccggaaagctgacgcggcagtctgtccagcagctcctccagctcaaggatttttgccgcttcatccacctgtttatcaatctgatctttcgggattttgctcagcttcaggccaaaggccaggttctcgcgcaccgtcatatgcggatagagcgcatagttctggaacaccatggcgataccacgcgctttcggcgcgagattgttgaccacgcgctcgccaatacgcacttcgccgccgctgatggtttccaggcccgccagcatacgcagggtggtggacttggcgcagccggatggcccgacgatcaccataaactccccgtcagcgattttcaggtcgataccatgtaccgctttgaagccgttggagtacactttttccagtttgttgaaaataacttcagccatgatatttccctcttaacctttaattccgctgctggtaacgccctgcacgaagtagcgctgagccaggaagaacacaatgatggacggcagaatggagatactcgccattgccagaatttcgttccacggcgcgccttcagtgacgtcgatggacattttcagcgccagggcgatcggatatttgtccacgctgtagacgtagatcagcggcccgataaagtcgttcattgaccacatgaactggaacagcgccacggagataatcgccggtttcaggatcggcaccaccacgtaccacagtacctgcgccgagttacagccatcgatctgcgccgcttcttccatgtcgcgcggcacgccgcgcaggaactggatcagcatgaagacgaagaacccttgcgtggcgaacgcggtcggcagatacagcggcagatagctgttcagcatgcccatttcacggaacatcaggtactgcgggatcagcagcacggtgcttggcagcaacatggtggcgataagcgtcgcgaaccagaacttcttccatggaatttcaaagcgcgcaaaaccgtaggccacaatggttgacgagatgatggtcagcagcactttcgggatcacatatttgaacgtgttccacatgtaatggccgaaggtgtattccgtgccggttttccagccgttcacaaagccgtcgctggtcgggtgggcaggccacagtccgagcgtggtgaagatctcgtggttcggtttgaacgacgctgagaacatccacgccagcggatagagcatcaacaggccaacaaacagcaggatcacgtagcggatcgcggcgctgatcttctctttacgctgcgtctgcgccacttcgcgctctgcgtctgtcattgcaggcgtaatttgttgtacgtcagccatttttgcctcccttatcggcggagtagaacacccagtattttgaagatttaaaggcgacagaggcgaagagtgccacgaccaggaacagtacccacgccagcgctgcgccatagcccatatcaaagtacttgaaggcggtgtcgtagatatagagcgagaacaggtaggtggagtaggtcggcccgccgccggtgatcacgtatggcccggtaaattcctggaaggcctgcgtggtctgcataatgaagttgaagaaaatgaccggcgtgatcagcggcaccgtcactttcatgaacatctgccatttggatgcgccgtcgatcattgccgcttcatactgtgattgcggaacgttttgcagtgcggcgaggaaaatcaccattgccgagccaaactgccagacgcgcaacagggtcacggacatcagcgccagcgacggttcgcccagccagttaatgggatccagaccaaacacgccgataaagctgtttagcagaccatcaatggcaaagagcgcgcgccacagcacggcaattgccacagagctgccgaggatcgatggaatataataagcggtacggaaaaaaccgatgccgcgcagtttaaagttcagtacaaacgcaatacccagcgcgaaggccagcttgagggggatggttaaaaatacataggcaaaggtcacgcccatggatttccagaagagagaatcttctgtcagcatatagcgatagttttctatgccgttaaataccggcgggctcatcaaatcgtactcggtaaagctgagtacaaaagatgaaacgaagggaaaggccgtaaagataatcaaccctatgatataaggtgaaatccaggctaatcccagtgctctgttttcattcatacatacctacctggcgatcaatggtttaaaacggaaccggagatttctggtgcccgcaccggtaaggcgaaggcgtaaatgtgcaaaatctttgcccttttccatgggcggtgtgaatgagttttaaaatcttctgaactcgcgttcttgatttgtaaaacatcgttttaatttattttattgtgatttgttacggcgtcattcgattaatcatggaaatgtgatcagagtcgaaacgacgtttcaataaggtgaggtgtgtgtcatttctgcgaaaaagatctgatgtatagacagggcgaatgacatacagaacatgaataaaacaaggcgcagccagaaatagatcaccgctaaaatcatttacagactaagtatttagcgcgtcggcataaataaaaacgccctccgtgcagagggcgctttaaacagtggcgggctatcagcttttaaggaaatcttcccgtaccggcgtgaaggtgtcgagcagcgtaccgggcttcaggcagacgcagccgtgcattacgtgcggtttcttgtaaagtgtatccccggcgctgacgatatgtttttcatcgccgatggtaaattcaaattcgccggagagcacataggtcagctgttcatgaggatggttatgaagcgggccgaccgcgccttcttcaaaattgacttctactgccatcattttaccgtcgtgcgcaaggatacgacgggtgacgccgttgcccaaatcgtcaagctgagtgtctttatggaaaataaacatcggatcgtcctgtagtcagtaaattgcatgaagtaaaacattgtttcattaaatttatatcagccagagctaaaaagaaacgccagagccggtgaagtggaaagccgatcacatattgttttgacgataacgtttaaggggaaaaagatgaaaacgataggcttgctcggcggtatgagctgggaatccaccattccgtattaccgcttaattaatgaaggggtaaaagcacggctgggagggctgcattccgccagcctcctgttgcacagcgtggactttcacgagatcgaagcctgccaggctaacggcgactggcataaggctggcgtgatgctggcggaagcggcggcggggcttgagcgcgcgggcgcgcagggtatcgtgctttgtaccaacaccatgcataaagtggcggggcagattgaagaccgctgtcaggtgccgtttttacatatcgccgatgccaccgcccgggcaattcagcgcgccgggctgaaatccgtggcgctgctcggtacgcgctataccatggagcaggagttttaccgtggccgactggcgcacaattttgggattcaaaccacggtgccggatgcggacgatcgcgggcgggtcaatcagatcatttttgaagaactttgcctcggcaccttcagcgagccgtcgcgtgactatttccttgggctaatcgcgcgcatggcggcggaaggggcgcagggggtgatattcggctgtactgaaatcgaactgctggtgccggctgaccagtgcccgatcccggtatttgacaccgccgcgctgcatgccgccgatgcggtggagtttatgctctcttaaggccgcgccagcaccgcatccagcggttcggtgatgcgcggcatggaagattgcagatgccgcgcaaaggcttccaccagcgccgaggcggggcggtgcagcgggcggatcaggctgacggtaaaaggcacgtcaatgctgaaacgcctgaccactacgccgctggcggcataatccagcgcggtcagcggatttaccaccgacacccccgcgcctgcccgtaccatggcgcacaccgacgccgcgctgtgcgtttccactaccatccgccgcttcacctgatgctccgcgaaaagcgcgtccagcaactggcgatagctgtcggtacgcgacaggctgatgtagttttccccctgaaaatcctccggcgtcagcacggttttatgcgccagcggatgatcctgcggcagtacgcacacttcgttaagcgtcagcagcggcgtgcgcccggtgcctgcgggcgtgctcaatgtctccgtcagccccagatcgtgacgctgcgcggacagccactcctccagcagcggcgactcctgcggtaccacgttgaggctgacctccgggtagcgcgccagaaagggttgcagcagcagcggcagaaacgactgggagaacaccggcaggcagaccaccgacagctccccctggcggaattcccgcaggctttcggcggcgctgacgatgcggtccagcccgtaccaggagcgttgtacttcttcgaacaaccgcagcccctgcaccgtgggatgcaggcggccccgcgtgcgctcgaacagcgtcaggccgatcaccttttcaaagcgcgccagctcacggctgacggtgggctgtgacgtctgcaacagccgcgccgcctccgtcaggttgccggtggtcatcaccgcgtgaaaaatttcgatatggcgcaggttaacggcgggcatgacaggttcctcatacaacatattcccatatcataaatgaatagactcgcgataaaacgatattttttatccggttcgcgttgtggcgtaatagctaaaaattattaaccggagccacctatgccacgctcacttaacaacaccgacaccgcccttaacgccgcgaacctgctggcgctgccggccctgtacggctgcccggtctgggcgtacgacgcgcagatcatccgcgaaaaaatcgcccagctcagtcagttcgacgtggtgcgttttgcgcagaaggcctgctccaacgtgcacattctgcgcctgatgcgcgagctgggcgtgaaagtggattccgtgtcgctgggtgaaattgagcgcgcgctggtggcgggttacgagccgcagaccagtcccgatgacgtggtcttcaccgctgatatgatcgacgccccgacgcttacgcgggtgcatgagctgcaaattccggtgaatgccggatcggtggatatgctgcgccaactgggggaagtctcgccagggcatcgcgtctggctgcgggtgaatccgggctttggccacggtcacagccagaaaaccaataccggcggcgaaaacagcaagcacggtatctggtacagcgatctgcctgaggcgctggaggtgattaagcgttatcagctgaagctggttggcctgcatatgcatattggttccggcgtggactatgggcatctggagcaggtgtgcggcgcgatggtacgccaggtgatcgagtttggtcaggatctggaagccatctccgccggtggcggcctgtcgatcccctatcgcgaaggggaagaggccattgatacccaccactattacgccctgtggaatcgcgcccgggagcagattgcggagcatctggggcatccggtcaagctggaaatcgagccggggcgtttcctggtggcggaatccggcgtgctggtggcgcaggtgcgcagcgtaaaaagcatgggtagccgccactttgtgctgatcgacgccggttttaacgatctgatgcgcccgtccatgtacggcagctatcaccacatcacggcgcttgcggcagatggccgtgatttaacaaccgcgcccttaatggataccgtggtggccgggccgctgtgtgaatccggcgacgtgttcacccagcaggagggcggcaaagtggaaacccgcgcgctgcctgcggtggtgcccggggattatctggtgctgcacgataccggcgcgtacggggcctcgatgtcctctaactacaacagccgtccgctgctgccggaagtgctgttcgagggcggcgagccgcgcctgatccgccgccgtcagaccatcgacgaactgctggcgctggaattactttaagcttttgaaatgcgggccgggggcgaccgaatcgcgcagtaccagcgtgccggtaaagggcgggatcgtctcaatggggcgatccgccgccagccgcatcgcctgatcaatggcggtggtgatcatgatgtcgataggcagacaaaccgtcgacagccccggctccagccatctggcgctgggggcatcatcaaaaccaaacagcgaaatatcctgcggaatacgcagcccggcctggtggatcgccttggacgcgccgagcgccatatcatcgttacaggcaaagagcgcgctgaaggcaacgccttcctgcaacagtgcctgacactgctcatagccgctggtcatacccgcatcgccatacctgactttcgccgcatcccagcggataccgtgcttttccagcgctttgcggtagcccatcagccgcgctttgccggtgggcgtgtggataggtacggtaatgcaggcgatatcgcgatgtccctgagaaatcagatattccaccgccttaaaagccgcgtcctgctgctcgaagaatacgcatttatcccgcgcctggctgacgtcgcggttgatcacaatcagcggcatcgggatgcgatcgataagcgccataatggctttttcgcgcataaagcgggtgtagagcacaatggcgtcgcagcggcggtccgccagcatctgcaccgcttcttcttcccgctccggggtatcgtgcccgtcggtgacaatcagctgcttgccgtgggtttccgtctggcgggaggcctgctgtaacaggcgtccaaaatagaagccgtcaaaggtcgataccaccaggccaatactgttactggtgcggttggccagcgactgggccagaaagttaggccggtagcccagctcttccatcgctttaaacacctgctgccgggtgctgtctttaacctgacctgtaccgttcagcacgcgtgaaaccgtcgcctttgagacgcccgcgcgcagtgaaacatccagcattgttgccatgacgacgtcctgtttcctgagttgagcgggagtttatcacaaaggctatatgacgttacggcctctccctgtggaaaagcgatgggtggaataccaatctacgcgcgatcacattatctggaataccactttctatcctgagagctttatcacagaacttttcccctacgctgtctacttttggtatgccagttggtattcggctgtaaccctggacaataaaaaagcccttttactgaggtaccatcgtatggctttacaggataagctcattgattctctgggtagtttcgcgacaacttttaacagttatcgctatattatggcgattaaatccgcctttattaccctgatgccggtcattattgtcggtgcgttttcagtactgatttccaatatggtgctggatccgaaaaacggtctcgccagttttcagtcgctgtcatttctggcggcgttaaaacccattaccagcgccattaattacgccacgctcaacttcttaaatatcggcgcggtatttttaattggtctggaattagggcgcattaacggcattaaatccttattccctggcctgctggcggttatttgttttatctgcgtgacgccaacgaccgtagaaatgctggtggacggcgaaatgcatgtggtgaaagacgtgctgctgcgtcagttctccgatacccgcagcctgttcctcggcatgtttatcgccattctgtcggtggaaatttattgctggctggaagggcgcaaggggctgaagatcaaaatgcccgacaccgtgccgcccaacgtcgctgcgtcgttttcggcgctgatcccggcgatcatcaccaccaccgccatcgccaccttcggattcgttttccatcaaatcaccggcttgtatctctacgacgccatctatcaggtggtgcaacagccgctggagcgtgtggtgcagagcctgccggggatcctgctgctgatgttcgtggcgcagctgttctgggtgatcggtattcatggtaaccagatgatcaaaccgatccgtgagccgctgctgctgggggcgatcaccgtcaatatgagcgctttcgaacagggcaaagaagtgccgaacatcatcaccatgccgttctgggatgtgtacatgagcatcggcggttccgggctgaccatcggcctgctgattgccgtgatgatcgccaccaaacgtaaagagatgcgcgagatcgccaagctctctatcggccctggcctgtttaacatcaacgaaccggtgattttcggcatgccgatcatgctcaacccgatcctcgcgatccccttcatcatcacgccgctggtcaccggatccattggctatttcgccaccgtcaccggtttcgccggaaaagcggtggtaatggtgccctggaccacgccgccactgatcaacgcctggctctccactgccggatcgatgggcgcggtgatcacccagtttatctgcatcgttactgcggtaattatctatctgccctttgtgaagatcgcctcgcgccgcgcggaacaggcgcagctgaaggcggaagcaacggaactggcgaaaaacgcctgaggacagtatgagcacgaaaaccatcgttatcccgccgtcatttatcctcggggcggcggcctccgcctggcaaaccgaaggctggagcgggaaaaaagccgggcaggactcctggccggatctctggtacaaaaacgaccgccacgtctggcatgaaggctacggcccggctgtcgccaccgattttcatcatcgcttccgtgaagacgtgcagctgatgaaagcggcggggctgacccactaccgcacctcgatcaactggtcacgcttttttaccgactacgagaatggcgtggtggatgaggagtacgccgcctggtatgacgaactctttgccgagatgcatcgccacggcatagagccgatgatctgccttgagcattacgagctgcccggttatctgctggaaaactacggcggctgggcgtcgaaaaaggtggtggagtttttcctgctgtatgcggaaaaagtctttgcccgctatcacacccaggtgacgcgctggttcacctttaacgagccgattgtggtgcagacgcgcgtctatctggacgcgctgcgctggccctatgaacaaaacaccggcacctggatgcagtggaatcacaacaaaaacctcgccacggcgaaagtggtgaaactgtttcgtgagaagggctatcagggcagcgtcggctgtattcttaatccggaagtgacctacccgcgctctcgtgcgccgcacgatgtgcgggcggccgacatgtacgatctgttctacaaccgcgtgtttctggatccgttagtgaagggtcattatcccccggagctgttcagcctgctggaacagcatcaggtggcgtgggagtacaacgacgaagaactggcgatcattcgcgataataccgtcgatgaactggggattaatctctattacccgcaccgcgtgaaagcgccgtcccgcgcctggcatccggacacgcctttccatccggcatactattacgagccatttgaattaccggggcggcggatgaataaatcccgcggctgggaaatttatccgcagattatttacgacatggcgatgcgcattaaaaacgactacggcaatattccgtggttcgttgccgaaagcgggatgggcattgaaaacgaggggcagttccgcaatgtcgatggcgtgattgaagatgattatcgcatcgcctttatcagcgaacatctttaccagacgctgcgcgccagggaagacggcgctaactgccagggttatatgctgtgggcgttcaccgataacgtctcgccgatgaacgcctttaaaaatcgctatggtttaattgagatcgatctgcaaaataaccgtaaccggcgcgccaaaaaatctgcctcatggtaccgtcggttaagcgaggagcgcacgctcacgctgactctcgacgatgaatggaaatagcaggtgatatggtggagaaagcagtcgtagtgacggaaaaaaaacagtaccaggagataggtgaggatctgcgcgcgcagattatccagggacactacccggtaggctcccgtctgccgccggagcgaaatattgccgaaacctacggcgtcagccgcaccatcgtgcgcgaggcgctgttaatgctggagttgcagggcacggtggatatccgccagggatccggggtgtacgtgatgcgcatcccccaggagcacgaaaacgaagaagaacgctttttaagcagcgacgtcggcccctttgaaatcctccaggcgcggcaactgctggagagcaacattgccgcctttgccgcaaaaatggccacccgcgccgacatcgacaacctgcggcgtattctggagcaggaacagcgcgccatcgccatgaatgacaattcccaggataacagcaaaatgttccacctggtgctggcaggggcgtcacaaaaccagatgctgctgggcacggtggaaagcatctggcatcacatggacagcagcccattgtggcagcagtttaatgtgcacatcgccagccgggcatatcgtctgaaatggctgggcgaccgccaaaccctgctggcggcgctgcgccgtcgcgatgtgatgggggcgtggcaggcgatgtggcaacatctggaaaacgtcaaaaaaagcctgctggagctatcggacgaagatgcgccggacttcgacggctatctgttcgaatccgtaccgctttttcagggaaaattaatgtgaagatccagccgctttacgacgtgccgcagtttaccggacaggtgatcgactggcagtggcgcgcctttggcgacgggctgccgcgggaattttttgccagcatcgtcgaacacagccagcgtcccggcgagctgccgctgaccttcgtggcgacggagggtgagcagttgctgggtacggtgggactctggcgctgcgatttaatcagccgtcaggatctgtggccgtggctggcggcgctgtatgtggatgaaagcgcgcgcgggcaggggctggcgggggcgctgcaacaacaggtgatagagtacgcccgcgggcagggctatccgcagctgtatctgtggtctgcctgcatggatttttacgagcgctacggctggcagtacattggcgacggccttgaatacccggacaaaaccgtgcacctgtaccgctatacgctttagctttcctgcaacgtgccgaccgagtggcgtcgtaccagcgtcgggttaaagacgtgggtaatatccggcagcggacgattttccgccagcgccagcgccagttcagcggcctgggtcgccatggtgacaatcggatagcgtacggtggtcaggcgcggacgcacgtagcgggagatcagaatgtcatcaaagccgatcagcgaaatctcacccggcacgtcaatgccgttatcgtttaacacccccatcgcccctgccgccatggagtcgttataacaggccaccgcggtaaagtttttgccgcgtcccagcagttcggtcatcgcctgttcgccgccgctctcgtcaggcgcagcccaggtcaccagccggtcgttgcacggcaggccattttcccgcagcgcgtcgtaatagccctgcagtcgatcttccgcatccgaaatggcgtgattagagcacagatagccgattttagtgtgtccctgctggatcagatggcgggtcgccagccaggcgccgtaacgatcgtccagcgccacgcagcgcgtttcaaagcccggcacgatgcggttgatcagcaccatgcccggcatctgttccatcagggcggcgagatcggcatcggggatcattttggcgtgcaccaccagcgccgcgcagcgatggcggatcagttgttcaatcgcctgccgctctttgtgttcgttatggtagccgttgccgataagcagaaaattgccggtgttataggccacatgctccacggctttcaccattgagccaaagaagggatccgagacatcgcccaccaccagcccgacggtttccgtcgactgctgcgccagcgcgcgggcattggcgttcgggtggtaattaagggattccatggcgctctgcaccgccaggcgcgacgattcgctggctttcggggagtggttgatcacgcgtgacaccgtggcaacagaaacacctgcaagccgggctacatcctttatcgtcgccatacagaaccttctttttgggtaagcgtttacacagcgttaagtgttacggaaaagcgccgtctgttcaaggcgattgcggtacgggacgccgtaaacgtgatcgacagcctactgcggctggtgaaaacgttacacgaggtggttgacagcaaataagacaaaaaaagcgaattcaaacctttggttacactttgcgaagggctgttgcgattgattactgtagggacaggggggctgttgctacagttaaagtcccagaggtattgattggtgagatttcagtacgttttgagtactcacgttttgcaccaacctgcgcggatgcgcaggttttttttcgtctggattttaccttcgccccttctgcacttctcgtgtaatctgccacaattccctgacatctttcatattaactgacacaggaagttgccatgttactggactttttccgttttttattccgcctgttgttcagggtcgaactgaccggcgatacccaggcgctccgcggtgagcgcgtactgatcacccctaatcacgtctcttttcttgacggcgttttgctggcgctgtttttaccggtacgtccggtgtttgcggtttacacctccatcagccagcagtggtacatgcgcgccctgcgcaatctgattgattttgtgccgctcgatcccacaaaaccgatgtctgttaagcagctggtgcgcatgattggccagggccgcccggtggtgattttcccggaagggcgcatctcggtgtccggatcgctgatgaaaatttatgacggcgcgggctttgtagccgccaaatccggcgcgaccgtggtgccggtgcgtatcgaaggcgcggagttgaccttcttcagccgcctgaaagggctggtcaaacagcgcctgttcccgcgcattcatatccgcatcctgccgcctacctcgctgccgatgccggatgcgccgcgcgcccgtgaccgtcgtaaaatcgccggcgaaatgctgcaccagatcatgatggaagcgcgtatggccgtgcgcccgcgtgaaactctgtttgaagcgctgcttgcggcgcaataccgttacggcgcgaacaagccctgtattgaagacatcaacttcaaaccggactcctatcgcaagctgttaacgaaaaccctgttcgtggcgcgtattctggataaatacaccgcgcagggcgaaaagatcggcctgatgctgccgaacgcggccatcagcgcggcggtgatctttggcgcggtcgcccgcgggcgcgttccggcgatgatgaactacaccgcaggcgtgaaagggctgaccagcgccatcaccgccgcgcaaatcaaaaccatttttacctcacgcacctttatggacaaaggcaagctctggcacctgccggagcagctgacgcaggtgcgctgggtgtatctcgaagatctgaagggcgacgtgaccctcgccgataagctgtggatcttcgcccacgtgctgatgccgcatctggcgcaggtgccgcagcagccggaagacgccgcgctggtgctgtttacctccggctcggaaggtaatccgaaaggcgtggtgcacagccataagagtctgctggcgaacgtcgagcagatccgcaccatcgcggattttacggctaacgaccgctttatgtcggcgctgccgctgttccactcctttggcttaaccgtcggcctgttcacgccgctgctgaccggtgcggaagtgttcctctacccaagcccgctgcattaccgcatcgtgccggaactggtgtatgaccgtaactgcaccgtgctgttcggcacctccaccttcctcggccactacgcacgtttcgccaatccttatgatttctatcgtctgcgttacgtggtggcgggggcggaaaaacttcaggagagcacgcggcaaatctggcaggacaaatttggtctgcgcattctggaaggctacggcgtgaccgagtgcgcgccggtggtctccattaacgtgccgatggcggcgcgccccggcaccgtcgggcgcattctgccgggtatggacgcgcgtctgctggcggtacccggcattgaagacggcggtcgcctgcaactgaaagggccgaacgtgatgaacggctatctgcgggtggaaaaccccggcgtgctggaagcgccgacggcggaaaatgagcgcggcgagatcgagccgggctggtacgacaccggtgacatcgtgcgttttgatgacagcggctttgtgcagatccaggggcgcgcaaaacgctttgccaagattgcgggcgaaatggtgtcgctggagatggtcgagcaactggcgctggcggtatcgccggaaaaaatgcacggcacggtgatcaaaagcgacgccagcaaaggcgaggcgctggtgatgtttaccaccgacagcgagctgacgcgcgacaagctgctccagcatgcccgcgcgcaggggatccctgagctggccgtcccgcgggatattcgctatctgaagcaacttccggtattgggcagcggcaagcctgattttgtcacccttaaaggtctgcttgaagacccggaacatcatcatgcgtgagtcacacactaacaattccctgtggtcgaaggggatgctggcagtcaccgccgcgcagttcctgtctgctttcggggataacgcgctgctgttcgccactctggcgctgctgaaagagcagtattacccggactggagccagccgatcctgcaaatggtgtttgtaggcgcttacatactctttgcgccttttgtcggccaggttgctgacagcttccccaaaggccgcgtgatgatggtggcgaacagcctgaaactgctcggcgcggcaagcatctgtctcggcgttaacccgtttattggctatacgctggtgggaattggcgcggcggcctactcgccagccaagtacggcattctcggcgagctgaccaccggcgataaactggtaaaggcgaacggtctgatggagtcctccaccatcgccgccattttgcttggctcggtagcgggcggggtgctggcagactggcacgtgctggcggcgcttggcgtctgtgcgctggtgtacgcgggtgcggtggtggcgaatttgctgatcccggtattgcctgtcgcccgtcccggccagtcctggcgtttcgtgccgatgaccaacagctttttcagcgcctgccgatctttatggcagaacggcgaaacccgtttctcgctggtgggcaccagtctgttctggggcgcaggcgtgacgctgcgcttcctgctggtgttgtgggtaccggaggcgctgggtattaccgataacgccacgccgacctatctgaacgcgatggtggcggtggggatcgtgttgggcgcaggcgtggcggcgaaactcgtcaccctggaaacggtgtcgcgctgtatgccagccgggattttaattggcgtcggcgtgctgttcttctccctgcaacatgcgctactgcctgcctatggcctgttaattctgattggtctgctgggtggattctttgtggtgccgctgaacgcgctattgcaggagcgcggtaaacgctcggtgggcgcggggaatgccattgcggtacagaatctcggtgagaacaccgctatgctgctgatgctggggctgtattcgctggcgataaaagtcggcgtgccggtggtgggcgttggcgtgggcttcggtgcgctctttgcgctggcgattgccgcgctgtggatctggcagcgtcgtcggtaaagaagtctgggatacgtaggccgggtaagcgcaagcgccacccggcaaaaaaaagccgggcatctgcccggctttttacatcacggtgccggataggtatacacccggtgcactgcttcaatctctgctaacacgtcctcactgagatcaagatggaagctctccacattggtcttcagctgtaccagcgtggtcgcccccagcagggtgctggcgacaaacggctggcgacgcacaaaggccagcgccatctgcgccggatccagattatgccgcttcgcaatatccacgtaagcggcgactgctttttgcgactgctcgccgctgtagcgggtaaagcgactgaacagggtattacgcgcgcctgccggtttcgcgccgttgaggtatttcccggtcagcgtaccaaaggccaggcaggaataggccagcagctccaccccttcaaactggctgacttccgccagcgccacttcatagctgcggttcagcaggctatacgggttctgaatggtgacgatgcgcggcagatcgtgcttgtccgccaggtgcagataacgcatcacgccaaacgccgtttcgttggagacgccaatgtaacgaattttcccggcacgctggtattccgtcagcgcttcaagggtttcaaggatggttacacccggcgcgctatccgtccactcatagcccagtttgccgaagcagttggtcggacgctgcggccagtgaacctgatagagatcgagatagtcggtttgcaggcgttttaagctggcatccagcgcctggcggatattttttcgatccagcgcctgatccgggcggataccgctgtcgctgttgcggctcgggccgctgacttttgaggcgataacgagtttttcgcggttaccgcgtttcgtcagccagttgccgacgtaagtctcggtaagcccctgggtttccgggcgtggcggaacagggtacatctccgcgacatcaataaaatttattccctggcttacggcataatcgagctgtgcatgggcgtcggcttcgctattttgttcaccaaacgtcatagtgcccagccccagagtgcttatctcaagggagctgtgagggatacggtgatagtgcatttgccggcttccttttgttaacaacgtcagtcgcttcctgacaaaggaatataaacatggcagaggggagtgaaaagggaaagtgaaaaatcaaaaggtcagcagggtactgaccctttcaggattaacgttcgataatctgtgaaacgtcgtcgcggttgatctgcatctcgttgccctgctgatcgcgatagctaaccagtccggtgtcatcatcaatttgtggtttaccatctgtcaggatcattttgccatctttggtcgccataacgtaatcactgctgcaccctgaaaccgcaaaagccaggcctactgcagagatcaccactgcccattttttcatcgttttattcctcgcgtgacggttaactgaatgtagtctagtaataacgcagaataatgtgatgaaaaagcagcaaattctgaaagcggaagaaaaaatgtacactcccccgggggcgggggagcggtaaatcagagcggacgcttcttgttgcgcaacagattgagggtttccacggcaatggagaagaacattgcgaaatagatgtagcctttcggcacgtggatgccgaaactttccagcatcagcgtaaagccgacgaggatcaggaaggccagcgccagcattttcaccgacgggtgacgatcgacgaattcgccaatcggacgcgccgcgaacatcatcacgccaacggcaatcaccaccgccgccatcataatgaacagatggtcagacagtcccaccgccgtaatcaccgagtcgagactaaagatgatgtccagcagcatgatctgcacaatcgcgcccataaaggagtggacgttggttttcagtccttcctcttccccttcaatggactcgtggatctctttgctcgctttccagatcaggaataagccgccaagcagtaaaatcagatcgcgtgccgacaccgcatggcccatcacctcaaacagcggcgtggtcaggcgtatcacccatgcgattgaggccaacagcgccagacgcatgatcattgctcccgcaaggccgagacggcgggcgcggttacgttgtgcgggcggaagttttgccactaccagagaaaggaaaataatattatcgatacccagcactatttccagcagcgtcagtgttccgagcgccagccaggcattgggatcggtgatccatgcaaataacatcgtaaaagtcctgccaaaaaaagaagggctaattataagcgcaagcccggtcagggcaaaatttaataaccctgcaacaaaaaatgccgcgccagcaatgcgcgggtaaaattctttttcagataaaagccgcggggcagggtcaggatacgttggccctcggtgcccacggcctcggtcagcgctttactgttcgccgctttcgggcgcagttgtaacacttcgccgtgacgcgcagtaattgtttcaacctgacccagtacgatgagatccattagctcctcccagtccaggcgcaactggcgctcctcatcttcatccggactccacagcagcggtgctcccacacgccgcacggcgagagggatctcccgcgatccttccaccgggatccacagcacacgctttaacttgtgacgcacatgactggtttcccacaccaccccgctattacccgtcaaaggggcaacgcacacaaaggtggtttccagcgggcgtccggcgttatccacaggaatggttttaagctccacaccgagcgccgcgaaatcctgttccggcttgctgcctgcgcttgcgcccagccagcgttccagcaggatcccggtccagcccttatcacgtttcagatcctggggcactggcagaccggccatttgacccagttctcctaacgtgaagcccgccagacgctgtgcctgcgccaacagctttgcttcggtatccggtggtgtagttaagggaacaggtgggaacatgattcagacctttggttaaaaaatgaacaacaattatgcaccggggtgagcagtgaggtttatttctgtgagcaaccttcaatactatgatttaacgactttttttggaaataatcacttatgttgcgcaacagcctgcccggttttccaattctggtcactggcaatgaacaggatcttacaccatgttatccacagaaaagtgggataactggtaaaaaccttcactactgtttccatttacagccttgacgtgggagcaaaatcgaattttcgcacaaattgtgtttaacttggtggcacaaactgtggataaaaccgacgctgtgcgatctttcatcagcgaggcgatcatccctgtgatgatcgtcacataaccgccttttcgttccggtataagtgcattaagctactgacgcatagcgctttattttttcatggcattaatgcggatttaggactactccgggttttccccctttaattccatacttcttcacaactatatccacagaaaaagtgaataaagtggccgcccggaaccctaatctgtttataactcggcagataactgtgagttattcaattgttattaggttatgcaccgttaacagagtggtttaccgtttaccactagtgtgaaacaatcgttcaaattcagattttttttgaggtagtccggtgattgatgacgatggctaccgccccaatgttgggatcgtaatttgtaaccgacagggccaggtgatgtgggccaggcgctttggtcagcactcatggcagtttcctcaggggggaattaaccccggagaatccccggagcaggctatgtaccgggagctgttcgaagaggttgggttaagtcgtaaagatgtgcgtatccttgcttctactcgcaactggttgcgttacaagttaccgaaacgtttggtgcgttgggacacaaagccggtgtgtatcggccagaaacaaaaatggtttcttctgcaattagtcagcagtgatgctgatattaatatgcaaaccagcagtacccccgagtttgatggctggcgctgggtgagttactggtatcccgttcgtcaggttgtctcctttaaacgcgatgtctatcgtcgggtgatgaaagagtttgcaagcgtagtgatggcgctttctgaagcgacgccgaagccgcaaagtcccccagcctggcgacgtaaaagaggttaagccatacataacatgctcacccggctgcgagaaatcgtcgagaaagtggcaagtgctccgcgcctcaacgaggcgctggacgtactggttactgaaatttgtcaggcgatggataccgaggtctgctcggtttatctcgccgatcacgacagacgctgctattacctgatggcgacgcgcggtttgaaaaagccgcgtggtcgtactgtcacgcttgccttcgatcagggcattgtcggcctggtcggtcggcttgcggagcccatcaacctggccgatgcgcaaaagcaccccagctttaaattcattcccgcagtcaaagaagagcgcttccgcgcctttctcggcgtgcccattattcagcgccgccagttgctgggcgtgctggtggtgcagcagcgtgaattacgccagtttgacgaaagcgaagagtccttcctggtcacgctggccacgcagatggccgccattctttcccagtcacagctggcggcgctctttggtcagtaccgtcagacacgcatccgcgcgctgcctgcctcgccgggcgtagccatcgccgaaggctggatggatgccacgctgccgctgatggagcaggtgtatgaagcctcgacgctcgacacctcgctggagcgcgaaaggctcaccggggcgctggaagaggcggccagtgaatttcgccgttacagcaagcgcttctctgccggggcgcagaaagagacggcagcgatcttcgatctctattcgcatctgctctctgacgcccgcctgcgccgggaactctttgaggaagtggaccggggctttgtcgccgaatgggcggtaaaaaaggttattgagcgctttgccgaacagtttgcggcgctgaccgatggctatctgaaagagcgcgccggggatttgcgcatgctcggccagcgtctgctcttccaccttgacgatacattacagggcccgaatgcctggcctgcgcgctttgtgctggtggctgatgaactctccgccaccacgcttgccgaactgccgcacgaccgactggtgggcgtggtggtgcgcgatggcgcggcgaactcccatgcggcgatcatggttcgcgcccttggcatcccgaccgtgatgggcgcagacattcagccgtcgatcctgcatcaacgcacgctgatcgtcgatggctatcgcggtgaactgctggtggatccagagccgatcctgatgcaggaatatcagcggcttatcagcgaagaaaatgaattaagccgtctggctgaagatgacgttaatctgcccgcccagctcagaagcggcgagcgggtgaaagtgatgctcaacgcgggcttaagcccggcgcacgaagaaaatctcgacagccgcattgacggcatcggtctttaccgcaccgaaatcccctttatgctgcaaagcggtttcccctcggaagaggagcaggtggcgcagtaccagggcatgatgcagatgtttatcgacaagcccgtcacgctgcgtacgctggatgtcggcgccgataaacagctgccttacatgccgatcagcgaagagaatccgtgcctcggctggcgcgggatccgcattacgctcgatcagccggagatctttttgatccaggtgcgcgccatgctgcgcgccaacgccgccaccggcaacctgaatattctgctgccgatggtcaccagcatcgatgagatcgacgaggcgcgacgtctgattgagcgcgccgggcgcgaagtggaagagatgatcggctacgccattcccaaaccgcgcattggcgtgatgctggaagtgccgtcgatggtctttatgatcgcccatctggttaaacgggtcgattttatctccgtcggcaccaacgatttgacccagtacattctggcggtggatcgcaacaatacccgcgtggcaaatatgtacgacagcctgcatcctgccgtgctgcgcgcgctggcgatgatcgccgacgaagccgaacggcacgacatcgatctgcggctgtgcggtgaaatggcaggggatccgatgtgcgtcgccattctcatcggccttggctaccgtcatctgtcgatgaacggccgctcggtggcgcgtattaaatatttgctgcgccatatcgatcacgaagatgcgcagacgcttgccagacgggcgcttgacgcccagctggccgccgaagttcgccatcaggtcgcggcctttatggaacggcgcagcatgggcgggttaattcgcggcggacgctaggtgcaggatccggcgaacgttatacatatcttttacaacttcagcgcaatcagcatgtccgccttatgctatgattcgcaactttggcgcgcctgtcgacgcgggcgcacgtctttgccgctgaccactttcggcggaataacaacaagttgtggtgacagatgaacagtggttatctgcgttttccggacatcgatccggtgattttctccatagggccgcttgccctgcactggtacggcatgatgtatctggtcggcttcatctttgcgatgtggctggcgacgcgccgcgctaatcgtcccggcagcggctggacgaaaaacgaagtcgaaaacctgctttacgcaggattcctcggcgtgttccttggcgggcgtatcggctacgtgctgttctataacttcccggtattcatgagcgatccgctgtacctgttccgcgtctgggacggcggcatgtcgttccacggcggtctgatcggcgttattctggtaatggtcatttttgcccgtcgcaccaaacgtcatttcttccaggttgcggatttcatcgcgccgctgatcccgttcgggctgggcgcaggccgtctgggtaactttatcaacggtgaactctggggccgtgtcgatccgggcttcccgttcgccatgctgttccccgcctcccgcagcgaagatatggcgctgctgccggcgcacccggaatggcagtctatttttgatacttacggcgtcctgccgcgacatccgtcccagctctatgaactggtgctggaaggcattgtactgttcatcattctcaacctgtttattcgcaaaccgcgcccgatgggtgccgtctccggattgttcctgattggttatggcgcgttccgcatcattgttgaattcttccgccagccggatgcgcagtttaccggcgaatgggtgcagtacatcagcatggggcaaattctctctatcccgatgattgtcgccggcgttctgatgatgatctgggcgtaccgccgtcgcccgcagctacacgtttcctgaggaaccatgaaacagtatttagacctgatgcaaaaggtgctcgatgagggcacccaaaaaaacgatcgtaccggtaccggcacgctgtctatttttggccatcagatgcgctttaacctgcgcgacggcttcccgctggtgaccaccaaacgttgtcatctgcgatcgattatccatgagctgttgtggttcctgcagggtgatactaacgttgcctatcttcatgaaaacaacgtctccatctgggatgaatgggccgatgagcagggcgatttgggtccggtatacggcaaacagtggcgcgcctggccgacgccggatggccgccatatcgatcagatctccaacgtgcttgagcagttaaaaaacgatccggattcgcgccgtattatcgtttctgcctggaacgtgggcgagctggacaaaatggcgctggcgccatgccatgcgtttttccagttctacgtggctgacggcaaactctcctgccagctttatcagcgctcctgcgatgtcttcctcggcctgccgttcaacatcgccagctatgcgctgctggtgcatatggtggcgcagcagtgcgatctggaagtgggcgacttcgtctggaccggcggcgatacgcacctgtacagcaaccatatggagcagacgcacctgcagctgagccgtgagccgcgcgcgctgcctaagctgattatcaagcgtaagcccgcttcgctgtttgactaccgcttcgaggattttgaaatcgaaggctacgatccgcatcccgccatcaaagcgcctgtcgctatctgatgcgcaaagcgtgacataaccggtgccttagcgcgccggttttttttatccgccgttccattttccggggcgtcttccggaaaaaatgcaaaggcctgcaacggcatttaaacctctcgtaacgccccgcaaaaccacgctttcccgttcgctctctctgcacgtcttcggcacactgccgccatgaaaaaacaacaaggcttcaccctgatcgaaatcctggtcgccgtggcgctggtcatcattctgagcggcgcagggctgtacggctggcagagtttccgcctgcaccagcagctgtggcaaaccgcctggcaggtgcgtgtttacctggagctgctgcgcgatgatgccaactggcagaaccgcgaccaccttatcagcgccagcacaacggaggacggctggtgcctgttaagttcggtgaatgagcgggcaggctgcgcggctgataatgcgtttgcgctgcggccgttgtccgcgggtgtggcgctggctgatatcacgccgtcgctgcgtttttttggtctgcgtaataccgcctggcccgggcatatcgtgctgcgcaatccggcgggcgaatggcgaattatcgtttcaaacggaggacgaataagaatgtgtcaacctgtggcggccacgccatgcatctgacccatcgcggctttaccctgccggaggtgttgatcgcgatgacaatcggcagcgtgctactgcttggcgcggcccgctttctgccggccttacagagggcgatgctcgcccagacccgccagcaggcgctggaagatgaaatctggcagcggctatataccatggcaaaacacgtgcagcgggccggttattgccgtggcctgtgcagcggccaaccgctggtgataaacccgcaggcgtcctgcatcattgtgcagtgggacggcaacagcaacggcgtgtgggatcgcgcgcctgcaaaagagccggatcagaccggatttcgcctgcacgacggcgcgctggaaacccggcgcggggcgacatcctgtcaggataagggctgggataaaatgaccgagcctgagacgatcaccgtagagcagttcagcgtgacgcacgtgcggcctgaaggttttcacagccagctcacgcttacccttgcggccagcgtgaccggccatccggacgagcgcatcaccgcccgccacagcgtaacgggttacaacctgtgaagcgccagcatgggatgtcgtcgctggggctggtactgctcatcatgctgctgggaagtgtgatgctgaacggactaaaccagcgccagcacacgcatcatctgcgggtggtcagcgaaagccgggcgctgcgcacgatggcggatgcgcagtccgccatggagtggggaagggtacagccatggcaatcccggcctgcggtgcagtgtcggcaggcgcacgaccatgactggcgcgcctgtctgcgaatttttgacgaccagacgctgctgctgatcgccgcgagcggcagccatacgctgtggcgtctgggcgcgctggaaaacgatctcgtgatattttcccgtcatggctggagtgatttttgcccgttcaccggggaggcgttatgtcagcttccctgaaaaatcaggcgggattcagcctgcctgaagtgctgctggcgatggtactcctggtgatgatcatcaccgcgctggcgggaacgcagcgtgcaataatgagcggttttatgcacgatagcctctaccgggaggtatggcgtaatgcctggcagcatatacagtggtatcctgttgctccgccagcaggctggcaggtgaagcgaatgcagacaagcacggcgggatgtgtcagcatcagcgtaacaatcacctctcccgtgggtcggcagggtcagatgtcgcggctatattgcccaatcagtcagtagtcaggagcatgtatgttaagggtttatcactccaatcgtctggatgtgcttgaagcactgatggagtttattgttgagcgcgaacgcctcgacgatccctttgaagctgaaatggtgctggtgcaaagcaccggcatggcgcaatggctccagatgacgctgtcgcaaaaattcggtattgccgccaatatcgacttcccgctgcccgcgagttttatctgggatatgtttgtgcgtgtgctgccggacatccctaaagagagcgcgtttaataagcagagtatgagctggaagctaatggccctgctgcccgacatgctggagcaggaggccttcgccatgctcgggaattatctgcacgacgatgacgacaagcgcaaactcttccagctcgcctcgcgcattgcggatctctacgatcagtatctggtgtaccgcccggaatggctgacccgctgggaagccggcgaatgggtggatggcttaggcgaagcgcagatctggcaggcgccgctgtggcgcatgctggttgagcataccgcggcgctcggacagccgcactggcaccgtgccaatctctatcagcggtttatccagacgctggagaacgccagtgaatgtccgccggggctgccgtcccgcgtctttatctgcggcatctccgcgctgccgccggtctatttacaggccttacaggcgctgggtaagcacgtagatgtgcacctgctgttcaccaacccgtgccgttactactggggcgatattaaagatccggcgtttctggcgaaactcatcacccgccgccgcaaacatcatcgcgaagcgcaggaaacgccgctgttccaggaagggctggaggtggaaagcctgtttaatgatgaaggcgagcaggacgtgggtaacccgctgctggcctcctggggtaagctgggacgcgactatatctatctgctggcgggactggatcgctatgacgaactggacgcctttgtggacgtcacccctggcacgctgctcaataatttgcagtcggacattctggagctgaagaacagcgtggtcgctggcgtcaccgccgaggagtatgcgcgcagcgatgcgaaacgcctgctcgatcccgccgatcgcagcgtcacggtgcacgtctgccacagtccgcagcgggaagtggaagtgttgcacgaccgtctgctggccatgatgcaggacgatccggaactgacgccgcgtgacatcatcgtgatggtgtcggatatcgacagctacagcccctttattcaggcggtcttcggcagcgccaccggggcgcgttttgtaccctatgccatttccgaccgccgggcagggcaggcgcatccggcgttacaggcgtttctcagcctgctgtcgctgccggacagccgtttccagtcagaagacgtgctggcactgcttgacgtgcctgtacttgccgcgcgtttcgatattgatgaagaagggctgcgttatctgcgtcagtgggtcaacgaatccggcgtacgctggggcatggatgacgataacgtgcgcgagctggaactgccgcctaccggtcagcatacctggcagtttggcctgatgcgtatgctgctgggctatgcgatggagagtcgccacggggagtggcgctcggtgctgccttatgatgaatccagcgggcttatcgccgaactggtggggcatctggcttcgctactgatgaagctcaatctgtggcgcaaaggcctgtcccaggcacgtccgctggtcgagtggctgccggtatgccgggatatgcttaatgactttttcctgcccgatgccgacaccgaagcggcgctggcgctgattgaacagcagtggcaggcgatgatcgcccacggcgtaggagctgcatataacgagtcggtaccgctgacgctgctgcgggacgaactgacgcagcgcctgaaccaggagcgtatcagccagcgttttctggccgggccggtaaatatttgtaccctgatgccaatgcgctctattccctttaaagtggtctgcctgctgggcatgaacgacggcgtatacccgcgcacgctggcgccgctgggatttgacctgatgagccagaagccaatgcgcggcgaccgcagccgccgtgacgatgaccgttacctcttccttgaggcgctgatttccgcccagcaaaaactctatatcagctacatcggacgctcgattcaggataacagcgaacgctttccgtccgtactggtgcaggaactggtggattacatcgctcagagccactatctgccgggggatgaatcgctcacctgcgatgacagcgcagcaagggtgatccagcatctgaatcacctgcacacccgtatgccattcgatgcggaaaactttgtcagcgatgaagtacagagcttcgcccatgagtggctgcccgccgccagccagcagggcgttgcccacgaaacctttattcagccgctgcccgcgcagcctatagagacgctggcgtttgagcagttacagcgcttctggacgcacccggtgcgggcatttttccagatgcgcttacaggtgaacttccgcccggaagccagcgacatccccgacgccgaaccctttattctggacggtctgaaccgctatcagcttaatcagacgctattgaatacgctggtggaacaggaagacgccgaaaagctgttccgccgctatcgtgccgcaggagaactcccctacggggcattcggcgaaattgtctgggaaacgcagcagcaggagatgcaggcgctggcggatcgcattaacgaatgccgcctgccttgtgaaagcatggagatcgaccttcactgcggcggtgtgcagctcaccggctggctacagcaggtgcaggccgacgggctgctgcgctggcgaccctccctgctcagcgtatcccagggactgcaactttggctggaacaccttgtctactgtgcgagcggcggcaccggggaaagccgtctgttcgtgcgcaaagacggcgaatggcgtttcccgccgcttgaagcagatcaggcgcatcactaccttgaacagcttatcgccgggtatcgcgaggggatgtcgcagcccttacttttactaccagaaagcggcggggcatggataaaagcctgttacgacgcgcaaaatgatgccatgttaaaggacgacgcgacgctggcgaaagcgcgcgcgaagtttcttcaggcttacgaaggcaacatggtggtgagcggcgaaggggacgatgtgtggtatcagcgtctgtggcgcacccttgaaccggaacactttgatgccatcaccgcccaggcggagcgctatttattgccgctctatcgtttcagtcagtcctgataaaaatgagtcgctggcggggccagtacagcgtttgttaatgatgaggtttgtgaatgccgagcagcacctggtttaaagcattaatcatttttgccgccctctgggcaccgttaagtcaggcagacaccggctggcaacccgttcaggaaaccattcgtaaaagcgataaagatacccgtcagtatcaggcgatccgccttgataatggcatggtcgtgctgctggtctcggatccgcaggcagtcaaatccctctccgcgctggtggtgccggtgggatccttacaggatcccgatactcatccaggccttgcgcactatcttgaacatatgacgctgatggggtcgaaaaaatacccgcagccggacagcctcgccgagtttttgaagtcgcacggcggcagccataacgccagtaccgcgccttaccgcaccgcttattatctggaagtggaaaataacgcgctggaaggagccgtcgatcgcctggcggacgccatcgccgcgccgctgttagacaaaaagtatgccgaacgtgaacgcaatgcggtgaatgccgagctgaccatggcccgcgcccgcgacggtatgcgcatggcgcaggtcagcgccgaaaccatcaacccggcccaccccggcgcgcgtttttcgggcggcaatcttgagacgctgagcgataaacccggcagcccggtgcatgacgctctgctggctttccgcgataaatactactccgctaacctgatgaaggccgtggtgtacagcaaccgtccgctgcctgagctggcgaaaatcgccgcgcaaacctatggacgcgtaccgaacaaaaatatcaccccgccggaagtgacggtgccggtggtgacggatgcgcaaaagggcctgattattcactatgtgcccgccatcccgcgtaaagtgctgcgcgtggaattccgtatcgacaacaacacgccgcagtttcgcagtaaaaccgatgagctggtgacctatctcatcggcaaccgcagcccgggaaccctctctgactggcttcaacagcaggggctggtggaagggatccgcgccgactccgatccggtggtcaatggcaacagcggcgtgctggcgatttccgccacgctgaccgacaaaggccttgcccatcgcgatgaagtggtggcggcaatttttagctatctgaaattgctgcgcgaacagggcgtggataaacgttattttgatgaactggcgcacgtgctggatctcgatttccgctatccgtccatcacccgtgatatgagctatgtcgaatggctggcggataccatgatccgcgtgccggtggaacataccctggatgcggtgaatattgccgaccagtacgatccccgggcgctgaaagaccgccttgacatgatgacgccgcagaatgcccgcgtctggtatatcagcccggatgagccgcataacaaaaccgcctattttgtgaatgcgccttatcaggtggataaaatcagcgcgcagacctttagcgactggcagcaaaaatccgccgccatcccgcttaaattgccggagctgaacccctatatcccggacgatttcaccctgctgaaaccgggtaaaacctttgaacatccggagcttatcgtggatgagccagcgctacgggtggtgtacatgccgagccgctatttcccgcaggaacccaaagctgatgtcagcgtggtgctgcgtaatccacaggcgatggacagcgccagaaaccaggtgctgtttgccctgaacgattatctggcaggtatcgcgctggatcagctcagcaatcaggcggcagtgggcggcatcagcttttcgactaacgccaataacggcttaatgcttaacgccaatggttatacccagcggctgccgcagctgtttgaggcgttgctgaaaggctacttcagctatgagccaaccgaagaacagctggcgcaggccaaatcctggtatgcgcagatgatggattcagccgacaaaggcaaagcctacgatcaggctattttgcctccgcaaatgctctctcaggtgccctatttccagcgggaagtgcgccgcgaactgctgccctctattagtctgcaggacgtggtggcctaccgtaacgcgctgaaaaccaacgcccgtccggaatttctggtggtcggcaacatggcggaaagcgaggcgaaagccttagcgcacaacgtacagacgcaactggggacgcagggtaatgaatggtgtcgtaaccgggatgtgctggtagataaaaagcagtcggtcatctttgaaaaagcgggcagcagcactgattccgcgctggctgcggtgttcgtgccgccgggttacgatgagttcagtagctccgcctacagcgccatgctcggccaaatcattcagccgtggttttataatcagctgcgcaccgaggagcagctcggctatgcggtttttgctttcccgttcagcgtcggacggcagtggggcatgggcttcctgttacaaagcagcgatcgccagccagcgtatctgtgggcgcgttataaagccttcttcccgacggcggaagcccgactgcgggcgatgaagccggaagaatttgcccagatccagcagggggtgatcgcgcaaatggagcaggcccctcagacgttaggtgaagaagcctcgcaaatcagcaaagatttcgatcgcggtaatatgcgcttcgattcacgtgataaagtagtggcccagattaaactgctgacgccgcaaaagctggcggatttcttccaccaggcggtggttgaaccgcacggtatggcgatcctctcccaggtttccggcagccagaacggcaaggctgagtatgtgcgtcctgacggctggaaagtatgggataacgtcagcaagttgcagcaaactatgcccctgttaagtgagaaagaatgaccgaacccgcccagacccttgatccactgcgcttgccgctgacaggcgagcgcctgattgaagcgtcggcggggacgggaaaaaccttcaccattgccgcgctctatttgcggctactgttgggccttggcggtccggcggcattcccgcgcctgctgagcgtggaagagttgctggtggtgaccttcaccgaggcggcgacggaagagctgcgcggacgtatccgcagcaatatccatgaactgcgcatcgcctgcctgcgcggttcttctgataatccgctgtatgccagcctgctggacgaaatccccgaccggcaacaggccgccagctggctgctgcttgccgaacggcaaatggacgaggcggccgtgtttaccattcacggcttctgccagcgtatgctgagccttaacgcctttgagtccggcatgctgtttgagcaacagctgattgaagacgaatccctgctgcgcgcgcaggcgtgcgcagacttctggcgtcgccactgttatccgctgccgcgtgatatcgcccaggtgatccacgcctcctggcagggaccgctggatctgctgaaatccatcaaccgctatttgcagggtgaagcgccggtgatcaaatcgccgccgccggaaaacgaaaccctggcggagcggcatcagcagatcatcacgcaaattaacgacatgaaagcccagtggctgacggcctgcaatgaaattgacgcagtgatcgagccatccggcatcgaccggcgtaagttcaaccgtggcaaccagggtaagtggatcgagaagatcaccgcctgggcgcaggaagaaacgcgcagctacctgctgcccgacgcgctggaaaagttctcgcaatccttcctggcgtcacgcaccaaaacggatggcgtggtgccggagcatccgctgtttgtcgcaattgaaacctttctggcccgtccgctgacgttaagcgatctggtgctggtcaaggcgatgaaagaaatccgcgaagccgtggcgcgggaaaaacgccgtcgcggcgcgctgggttttgacgacatgctcagccgtctcgacagcgccctgcaaagtgaaaacggcgacgcgctggccgcggcgatccgccagcgttttccggtggcgatgatcgacgaattccaggataccgatccgcagcagtatcgtattttccgccgtatctggcgacaacagcccgataccgcgctgctgttaattggcgatccgaaacaggcgatctacgcgttccgcggcgcggacatttttacctacatgaaagcgcgtagcgaagtcagcgcccactacacgctggataccaactggcgctcggcgccgggcatggtggccagcgttaatacgctgttcagccgcatggataacgcttttatgtttcgcgagatccccttcctgccggtgaaatccgcgccgaaaaacagcgcgttacgctttgagtttaacggtcagatgcagcctgccatgagcctgtggctgatggacggcgacggcgtcagcgtcggggattatcagacctttatggcgcagcactgcgccgcgcaaatccgcgactggctgattgccggacagcagggcagcgccgtgctgcacgatggcaaagtcagccgcgcggtgaaagcctcggatatcaccgtgctggtgcgcagccgccacgaagcggcgctgatccgtgatgcgctgacgctgctggccatcccgtccgtttatctctccaaccgcgacagcgtatttgaaacccctgaagcgcaggagctgctctggctgttacaggcggtgctggccccggagcgggaaagcacgctgcgcagcgccctggccacctccatgctgggtctgaacgcccagcacatcgaagcgcttaatcttgatgagcaggcgtgggatgaggtggtagaggaatttgatggttatcgtcagctgtggcaaaagcgcggcgtgatgccgatgctgcgcgcgctgatgaagcaccgcaatattgcggaaaatctgctggcgacctccggcggcgaacgtcggctgacggatattctgcacatcagcgaactgctacaggaagcaggcgcgcatgccgagagcgaacatgcgctggtgcgctggctggcgcagcatatcgccgagccggacagtaacgcctccagccagcaactgcggctggaaagcgacaaacatctggtgaaaatcgtcaccattcacaaatccaaaggtctggaatatccgctggtctggctgccctttatcgccaactaccgcgcgcaggaccaggctttctatcacgatcgcacgtcctttgaggcggtgcttgacctgagtgatgccgaggagagcgtggcgctcgccgaagctgaacgtctggcggaagatttacgtctgctgtacgtggcgctgacgcgttcagtgtggcattgcagcctgggaattgcgccgctgtttcgccgacgcggtgagaaagccggcgacagcgattttcatcacagcgcatgcggacgcctgatccagcagggcgagccgcgcgacgccgccgggctgcgggcctgcctgcaaagcctggagagtgacaacatcgcgctgcacattcccggcgtgccggataaccgccgctggcagttcaacagcgaggtgccgccgttgctgcgcgcgcgcgacattgagcgcctggtgcgcgatgactggcgcgtcaccagctattccggcctgcaacagcgtggacacagcatggcgcaggatctgctgccgcgcttcgatctcgatgccgcaggcgaacgcgatgcgcaggaaaccccggcgctgacgccgcaccagtttccgcgcggcgcgtcgcccggtaccttcctgcacagcctgtttgaagatctcgatttcactcagccggtcgcgcctgaatgggtggcggaaaagcttgagctgggcgggtttgacgagcactggcagccggtactgagcgagtggatcaacgcgatcctacaggtgccgctcagcgggccaggcatttcgttaagccagctgccagcccgcgaaaagcaggtggagatggagttttatttgccgatcagcgctaccctgaccgcaccggcgcttgatgcgctgatccgccgttacgatccgctgtccgccgactgcccgccgctcgatttccgcgatgtacgcggcatgctgaaaggctttatcgaccttgttttccgtcataacgggcgctattacctgctcgattacaaatcgaactggctcggggaaagtagcgaagcctatacccaggcggcgatggcgcaggccatgcaggcgcaccgttatgatctgcaataccagctctacaccctggcgctgcaccgttatttacgacaccgcatcgccggatatgattacgagcagcacttcggcggcgtgatttatctgttcctgcgcggcgtggatcgcgacgcgccaggccaggggatttttgccacccgcccggatgtgcaactgattagccagatggacgcgctgttcgccggtgagatgcaggagaacagagaatgaatatgcagaatttattattagaggccgtggcgcaaaaagcgctgcgtccgctggatgtgcagtttgcgctgaccgtcgcccgtgacgatgaacccgccgtgatgctggtggcggcgttgttaagccgcgatgcgggggaggggcacgtctgcctgccgctgtcgcgcctgtccgtcgccgagttcaatcgcctgtatccgcagctgttgcccttgctggaagaagcgggcgtaccggatgactggcgcgcaatgctgcttgcttcgcctgcggtgagcgcaggagatgagccgacgcccatggtgctgaccggtgagcggttgtatctcaaccggatgtggtgcaatgagctgacggtggcgcgctttttctgcgaggccaaccagccgctgccggtgaatgaagatgaaattaaacgctcgctggacgatctctttccggcaaccgacggcatcaactggcagaaaatcgccgccgctgtggcgctgacaagacggatctcggtgatctccggcgggcctggcacgggtaaaaccaccaccgtcgctaagctgctggcggcgctggtgcagaccgccaacggcgacaaatgccgtatccggctggcggcgcctaccggcaaagccgccgcgcgactgaccgaatcgctcggcgcggcgctgcgccagctgccgttaagcgatgagcaaaagaaacgtctgccggatgaggccagtacgctgcaccgcttgctgggggcgcagccgggcagtcagcgcctgcgctaccatgcgggcaacccgctgcatctggacgtgctggtggtggatgaagcctccatgatcgacctgccgatgatgtcgcggcttatcgacgcgctgccgccgcacggacgggtgattttccttggcgatcgcgatcagctggcgtcggtggaagccggtgcggtgctgggagatatctgcgcctgggtgaacgccggttacagtccgcagcgtgctgaagagctgtcgcgtctcacaggcatgcaggtgccctgcggcgaacaacagggcgcagaggcgctgcgtgacagcctctgcctgctgcaaaccagttaccgcttcggcagcgattccggtatcggccagctggcggccgcggtaaaccggggcgataagcccgccatgcgcgccgtcttcagccagggctttaccgacatcggcaaaagcaccttacagaccggcgatgattatcagaccatgatcgatgacgcgctggcaggttatgcgcgttatttacaactggtacgcgacggcgcgccgccagaagacgtgctggcggcgttcagcgagtttcagttgctgtgcgcgctgcgcgacgggccctttggcgtcggcggtttaaacgagcgccttgagcaacgactggcgcagaaacgctggctggtgcgtcatgcccactcccgctggtacgaagggcgtccggtgatgattgcccgcaacgacagcgcgctggggctgtacaacggggatatcggcgtggcgctggatcgcgggcaggggacgcgcgtctggttcccgctgccggacggcaccatcaagtctgtgcagccgagccgtttaccggatcacgataccgcctgggcgatgacggtacataaatcccaggggtcggagtttgaccatgcggcgctgattttgccggggcagattgtgccggtggtgacccgcgagctggtgtataccgccatcacccgtgcgcggcgcaggctgtcgctgtatgccgatgaccgtattctggcgcaggcgattgccacccgcaccgagcggcgcagcggattaagcgacatcttttcactgtgaaagcacccccgcccgctgcgggggcgtaaatcagccgagatccgccatcagcacttttgaacggcgctgatagttgtacatctcttttttgctctccggcagggaatcaatatccaccggcgtaaagccgcgctcctggaaccagtgaatgctgcgcgtggttaacacgaagagtttgctgagtcccatctgccgcgcctgtaaagccacacgctccagcaatacctcaccgcgggacgagctgcggtagtccgggtgcaccgccacgcaggccatttcaccgattttttcttccgggaacggatagagcgccgcgcaggcgatggtcaggttatcgcgctggataatagtgaatttgtcgatctccatctccagttgctcacgcgagcggcgaaccagaataccctgctgctccagcgggcggatcagctccagaataccgccgatgtcgttgatggtcgcacgacggatctgctcggcgctctccattacgatttgcgtgccgataccgtcgcgggagaacagctcctgcaacagcgcgccatcttcctgatagctgatcaggtgactgcgacgcacaccgctgcggcaggctttgaccgccccgcgcagaaagcgcaccgtgcccgactggtaatcctgacgcgcctccagctcctcaacacgcgcctgggcatcgttggggaacagctctgagacgatattgccatcgtcgttgatcaccccctgcgaggagcagaagccgatcattttctccgccttcagcttaatcgccagctgggtggcgatctcttctgacgtcaggttgaagctttcacccgttaccgataccgccaccggccccatcagcacaatggcgccgctgtccagctggcggtgaatggcttcctcgtcgatacgacggatacggccgctgtggcagtagtccacgccatcatccacgcccagcggctgagagataataaagttgccgctcaccacgttgatatgcgcgccctgaagcggcgtgttgttgaggctcatcgacagccgggcggtaatatccagctgcaactgacctgccgcctgtttaaccagctccagcgttttggcgtcggtcacgcgggtatgtttgtgataaaccggctcgtgatgatgcgcggcaaggttcgcgtcaatttgcgggcgtgcgccatacaccaccaccaggcgaatgccgaggctgtgcagcaagccaatgtcattgacgatactggaaaagttctcatgctcaatggcttcgccgcccagcatgatgacaaaggttttcccccgatgggcattaatatagggaactgaatggcggaatccctcgaccagttcggttctacgctccttcaccacggcacaaccctcactgcatgattattcggattttgtgtatttttattcttttatggcggcgggcgcaagcctaaatttgccgcggctccattttcattgccacgagaattaagttacgaatgctatgtttacccttttgttgatgacagtttatgcgtcattcgttaaagttttcggtcaatttggacgtatagatagcttattagatttactttgctcgggagaggcatgtcaggatccaattcaattatcagccgccgccgtttactgcaaggggcaggcgcgatgtggttgctcagcgtaagccaggtgggactggctgcggtaagccaggttatcgccgtgcgcgtctggcctgcatccacctacacgcgcgtgaccgtggaatcgaaccggttattaaaatatcgccagttcgccctgagtaatcctgaacgtctggttgtggatattgaaggcgtcaacctgaactcggtcctcaaaggcgtgggcatgcagatccgcgatgacgatccctttatcaaatccgcgcgcgtcgggcagttcgacccgaaaaccgtgcgtatggtgtttgaactgaaacagaatgtaacgccgcatctgttctcgctggcaccggtcgcggagtttaaagagcgtctggtgatggatctctatccggtaaacggacagaacgaacaggatccgctgctggcgttgctggaagattacaataaaggtgagttagatcggcaggtgccgcctgcgcagagcggaccgaagccggggaaagcggggcgcgatcggccgattgtgatcatgctcgatccgggacacggtggggaagatcccggcgcgattggcaaatataaaacccgggaaaaagacgtggtgctgcaaatcgcccgtcggctgcgagcgctcatcgatcgtgaagccaatatgaaagcctatatgacccgtaacgaggatgtgtttattccgttgaaggtgcgggtggcgaaagcccagaagcagcgcgcagatctgtttgtctctatccatgcggatgcctttaccagccgggcagcgcggggttcatctgtatttgcgttgtccaccaagggcgcaaccagtaccgcggcaaaatttctcgcccagacgcagaacgccgctgacctggtggggggcgtcagtaaaagcggcgaccgctatctcgatcacacgctgttcgacatggtgcagtcgctgacgattaacgacagcctgaagtttggcaaagaggtgttaaagcgtcttggcggtatcaacaaactgcacaaaaaccgcgtggatcaggcaggcttcgctgtactgaaagcgccggatattccgtcgatcctcgtcgaaacggcgtttatcagtaatatcgaagaagagcgcaagctgaagaccgcgaagttccagcaggaagtggcggagtcgattctggcagggatcaaagcgtactttgcagagggcggggcactggcacggcgcggataacgcgtcgtttttttacggaacgcagaaacaaaaaaacacccgtcagggtgtttaatgtgttggttgcgggggccggatttgaaccgacgaccttcgggttatgagcccgacgagctaccaggctgctccaccccgcgtccgtctttactcttccatcgagtaaactttctctttgtgcataattggttgcgggggccggatttgaaccgacgaccttcgggttatgagcccgacgagctaccaggctgctccaccccgcgtccgtcttttactctttcattcgagtaaacgtcttactgtaatgcacttaattggttgcgggggccggatttgaaccgacgaccttcgggttatgagcccgacgagctaccaggctgctccaccccgcgtccgtggaagcgcactatactccgctcgctctttgacgcaaccctttttccaaaaaaaggcgaatttcattgagcatctgaataaaaatagtgcagccaggctattttttatactcctcggggctgtgatgccgttcgcacatttcattagcgacacgggtttgttatcttcagagcacgcattcggcttaagtaagaagacgagacataatgaaaggacgttgggcgaagtacctactcactggcgcgatggtggtgatcctcgcagcctgttcctccaaaccgaccgatcgcggtcaacaatataaagacgggaaattcacccagcctttctctctggttaatcagccagacgccgtaggcgcgcccattaacggcggcgattatgccgaacaggtcagtcaggtgcgcaccgcgtcaccgcgtttatatggcaaccagagcgccatctataatgccgtgcaggactggctgcgcgcgggtggcgatacgcgcaccctgcgccagtacggtctggacgcctggcagatggaaggcgcggataactacggcaacgtgcagttcaccggttactacacgccggtagtgcaggcgcgtcatacccgtcagggcgaattccagtacccgatttatcgtatgccgccaaaacgcggacggctgccgtcccgggcggagatctacgccggggcactgagcgacaactatatcctcgcctacagcaactcgctgatggacaactttattatggacgtgcagggcagtggctatattgatttcggcgacggcagcccgctcaacttcttcagctacagcggcaaaaacggccatgcctaccgcagcatcggtaaagtgctgatcgatcgcggcgaagtgaagcgggaagatatgtcgatgcaggcgatccgtcactggggcgaaacgcacagcgaggcgcaggtgcgcgaactgctggagcaaaatccgtccttcgtcttcttcaaaccgcaatcttacgcgccggtgaaaggggcgagcggcgtgccgctgattggccgcgcatccgtggcctctgatcgcagcattattccggccgggacaacgctgctggcggaagtgcctttgctggataacaacggcaaattcaacggccagtacgagctgcgtctgatggtggcgctggacgtgggcggcgcaattaaaggccagcacttcgatatttatcaggggattggcgcagacgccggtcatcgcgcgggatggtataaccattatggccgcgtgtgggtactgaagaccgcgccgggcgcaggatcgggtaacgtgtttagcgggtgatcgtgctactattttgcccctctcctgcaaggggaaggtgatcatcaactccatttctgaggttttatgtctgcggtaatcagcgacgcctggcgtcagcgttttggtggcacagcgcgtctgtatggcgaaaacgcgttgcagctttttgcggatgcgcatatctgcgtggtggggatcggcggcgtcggatcctgggcggcggaagcgctggcgcgcaccggcatcggcgctatcacgctgattgatatggatgatgtctgcgtcaccaacaccaaccggcagatccacgccctgcgcgacagcgtgggccttgcgaaatccgaagtgatggctgagcgcattcgtcagatcaacccggaatgccgggtgacggtagtggacgatttcgttaccgccaacaacgtggcgcagtacatgagcgccggattcagctatgtgatcgacgccatcgacagcgtacggcctaaagcggcgctgatcgcttactgccgtcgtaataagatcccgctggtgaccaccggcggcgcgggcgggcagatcgatccgacgcagatccaggtcagcgatctggcgaaaaccattcaggatccgctggcggcgaagctgcgcgaaaggctgaaaagcgatttcggcgtggtgaaaaacagcaagggtaagctcggcgtggactgtgtgttctccaccgaagcgctggtgtatccgcaggcggacggctcggtatgcgcgatgaaaagcaccgcagaagggccaaaacggatggactgcgcctcaggctttggcgcggcgaccatggtcaccgccacttttggttttgtggcggtgtcccatgcgctgaaaaaaatgatggcgaaagcggcgcgtcaggcctgacgcgcggcatcctgtacggcggcggccagcgccgccagcccctgactgcgcgatgcgctgagctgtccgcgtaatcccagctcatcaaacagcgccagcggatcctgcgccagcagggtcggcgcggtttttccctccaccgccgtcagcagtaccgccagcagtccccgcacaatgcggccttcgctgtcgccgaagaaatgcagttttccctcgcctgaaagggtatgtcccagccagacgcgattttcacagccgggaatttcccgcgcctgggctttaagatcgtctgacagagcaggcaactgtttaccgagcaggatcagctgtcggtatttatcttcccactgcgtcagcgggttaaagatctgacgcagtgtgtcttcggttacggcgctgccgaacgggtgtccggcgaaagcagggttagtcattaatccaccagaagttcaagggcgcggtcgatggcgttaaccagcgcatcgacatcgtttttcgtattatagggcgcaaaagaggcgcgcagtgtaccgctgacgccaagcgccgccagcagcggctgggcgcagtgctggcctgcgcgcagcgcgatgccgtactctgccagcagcgtcaccatatcgctgtggtgcaccccggcaaaatcaaaggccagcaggctggagtcctggcaacggaacgagcggaagccggggcgttttgccagcgcgtcttccgccagcgtcgccagcccgcggctgtagctttcggcctgccccatatccatttcttccagccattccagcgccgcgctcagcccaatcaccccggccacgttcggcgtgcccgcctccaggcgccagggcaccggctgggttttaaagccgtcaaaggtgacctcggtgatcatcttaccgccgcccagccagggggacatcacctccagcaattcgcttttgccgtacaacgcgccgatgccggtcgggccatagagtttgtggccggaaaaagcataaaaatcaatgtccagcttttgcacgtccgccgggaagtgcaccgcgccctgtgcgccatccaccatcaccaccatgccggcagcgtgggcgagagttatggcgcgcgccagatccgggcagccgccggtgacgttggacatttgcccgatggccataatgcggctgcggggggtgatcagcgcgggaagttgttcaatgtccggcacaccgtcggccgcaacaggcagcttcaccacgctcgcgccggtttgctccgccaccatcagccagggcaccagattggcatgatgctctgcctcgctgacgataatctcatcgcctggctgtaaacgcggacgcgcataacactgggcgaccatattgatcgcctcggtggtgccccgcgtccagacgatgttgttaccggcaggcgcgttaagcagggcggcaacctggtcgcgcgcggcttcatagcgcgccgtcagtttttgcgcctgcgcatgctggctgcgatgcacgtttcctgcgctcaggctgtaaaactgctgcgtggcgtcaatgacggcctgtggttttagcgcagtggcggcgctgtccagatagacgcccgcatcggcaagagcaggaaattgggcacgaaaatgggcaggattgaatgcgttcatggcgttcctcatagtcagacgatgatcgtcgcgcaatttgcaaactgatacaagcgcctgtgctccatcagatttttctgtttatcctggcgcactttcgaaagcaggttatgctaaatagtgttgggtggacgttgaaccctgttaataaacaagattcagatagcattaattgctaaaaggagaagaatcatgaaaaagactgccgccattattaccgcatgtatgatgacttttgcactgagcgcctgttcgggtccgaactatgtaatgcacaccaacgatggccgttccattgtgtctgaaggtaagccgaaaaccgacgatcaaaccggcatgatctcttataaagacgctaacggtaacaaacagcagatcaatcgcactgacgtaaaagaaatggttgctctggaaaaataatagcccgtttcagagtaaaaaaaagcaccgcaatttgcggtgctacattaatcactatggacagacagggtaaatgtacaggaagtgaaaagggtagcgttgctaccgtggtctgaatagcagaccaattgcaaacacaacatcacaaccgcaagccaaaagcccttcagaacacgcattccaaaaaagactcttcgttccggctcaggaagtgccgccactataggtatttgctggtagttcctcaacggacaaattataatgtctcagataaaaaaaactaatgggttaaaccttgtttcctgtttgttaaattccattaacatctgaaccttataatcatgtccaagcgcttaccacctcttaatgcattacgtgtttttgatgccgccgcacgccatttaagcttcacccgcgccgcagatgagctttttgtgacgcaggccgcagtaagccatcaaatcaagtctcttgaggatttccttgggctgaagctgttccgccgtcgcaaccgttctctgttattaacagaagaaggtcagagttattttcaggatattaaagagattttttcccaactcaccgacgccacccgcaaactgcaatcgcgcagtgctaaaggggcgctgaccgtcagtttattgcccagttttgccattcagtggctggtgccgagactcaccagctttaattcagcttatccgggaatcgacgtcaggatccaggcggttgaccgcgaagtggacaagctggcggatgatgtcgatgtggcaattttttatgggcgcggcaactggccgggcttgcgtgtcgaaaaattatacgcagaatatctgctgccggtctgctcgccgttattgctcactggcgataagcccctgaaaacgcctgcggatctggcaaaacatacgttattgcatgatgcttcccgccgcgactggcaaacttatacgcgacagttaggtcttaatttgaatgtgcagcagggaccgattttcagccatagcgctatggtgctacaggcggcaatccacggacagggtatcgcgctggccaacaatgtgatggcgcagtccgaaattgaggcaggccgactggtctgtccgtttaatgatgtactggtcagtaaaaacgcgttttatctggtttgtcatgacagtcaggcagaactgggtaaaatagccgcctttcgacagtggatcctggcaaaagcggcatcagagcaagaaaaattccgcttccgttacgagcaataattcaacgcgcgcgatttcgcgcatgactttttagggtactgacatgaccagccggtttatgctgatttttgctgccattagtggctttgtttttgttgcgctgggcgccttcggcgcgcacgtgctggggaaatctctgggcacggtagagatgggctggatccagaccggtcttgaataccaggctttccatacgctggcgattttctgcctcgccgtggcgatgcagcgtcgcatcagcatctggttttactggagcagcgtgtttctggcgctgggtacggtgttgttcagcgggagcttatactgcctcgcgctttcccatctgcgcctgtgggccttcgtcaccccggttggcggcgtctgcttcctcgcgggctgggtattaatgttaattggtgctattcgtctgaaacgtaagggcgttgttcatgaataaagttgtcttgttgtgtcgcccgggttttgagaaagagtgcgccgcagaaattaccgataaagccggacgccttgaggtgtttggctttgcccgcgtgaaagaaaactcaggctatgtggttttcgaatgctatcagcctgatgatgcggataaagtggcaaaagatctgccgttcagctcgctgatttttgcccgtcagatgtttgtcgccggtgagctgttacaggatctgccgcctgacgatcgcatcacgccgattgtcggcatgttgcagggcgtggtggaaaaaggcggcgagctgcgcgttgaagtggcggacaccaacgaaagcaaagagctgatgaagttctgccgcaagttcaccgtaccgctgcgtgcggcgctgcgcgaggcgaaaatcctcaccagctacgaaaccgcaaaacgtccggtggtgcatgtgttctttatcgctcccggctgctgctatgccggttattcgtataccaataacaactcgccgttttacatgggcattccgcgcctgaagtttccgtcggacgcgccaagccgttccaccctcaaactggaagaagcctttcatatcttcattccggcagacgagtgggacgagcgcctggcaaacggcatgtacgcggtggatctgggcgcctgtccgggcggctggacctatcagctggtgaaacgcaacatgtgggtggcctctgtggataacggcccgatggcgcagagcctgatggataccgggcaggtcacctggctgcgtgaggatggtttccgctatcgcccgacgcgcaataacattacgtggatggtgtgcgatatggtggagaaacccgcgaaagtcaccgctctgatggtgcagtggctggtcaacggctggtgccgcgaaaccattttcaacctcaagctgccgatgaaaaaacgctacgaagaagtgtccggcaatctggcgtacattcaggagcaactggcggagcacggcatcaatgccactattcaggcccgtcagctgtatcacgatcgcgaagaagtgaccgtacacgtgcgccgctggtgggctgcggtgggcggacgtcgcgacgagcgttaaaactgcaaccctcaccctgaggtaaagtgtggatccctctccctggagagagggtcagggtgaggggattatctcgccagccgcagctgctgcaaattcccttccacctgtagatccgttttcagccttgccacatcccggcagataaacgccatttcgcgatgttccaccagttttttgcgccacttttccggtacctccgcaagccctgcatagagattttccagcgtgccaaaggtggtgataagctgcgtggcgctcttctgcccgatacccgccacgcccggaatttttgaactgctgatccccgcgagtccccagtaatctgccagttgctcaggcgtgacgccaaattcagcggcgataaagggcgcatccagccagcgcttctgaaaatagtcgcggatgcggatggtcggagagagcagctggcagtagcctttgtccgttgacactatggtggcctgatgcccggcctgcgccacttttaccgccagggtggcggccagatcgtccgcctcattgccttctgacacccagcatggcacgccgtggctggcaaaggccgcacgcagggcaggcatttccgcgtgcaggttgtccggcatcggcgcgcgacctgctttgtaatccggcaggatctgatgtcgccagccgctgttgcgcgcctcgtcatcaaagaccgccaccgcatgagtcggctggctgtgaaggatcaactggtcgagcgcgtgcaggcaggtctggacgcagggcgatccctgcacggcatggatccggcgaataagattaagcgcatcaacaattaacagatgaacagccacagcacgctcccgaaaaaatttaacgcgctaagggtaacaccggcggtgaggaggaggccagaaagcgggggaaaaacaggaagacgcctcgcaaaaaagccgggtggcataagcgcacccggcttcataaaggaacgactgacgtgattaatcgcaggcgacgactttcatcgccagaccgccacgggatgtttcgcggtatttggcgttcatgtctttgcccgtctcatacatggtctcaatgactttatcgaggcacacgcgcggctcgctggtacggcgcagggccatacgcgcggcgttcaccgctttcaccgaggcaatggcgttgcgttcaatgcagggtacctgtacctgtccggcgaccggatcgcaggttagccccaggttatgctccatgccgatttcggccgcgatgcacacctgcgtcgggctgccgcccagcaattccgccagacctgccgctgccatggagcaggccacgcccacttcaccctgacagcccacttccgcgccggaaatggaggcgttcattttgtacagggagccgattgcgctggcgaccagcagatagcgggccagtgagttagcatttacttcacgaataaatttatcgtagtacgccagcaccgccggcacgatgccacaggcgccgttggtcggcgcggtcaccacacgtccaccggcggcgttttcttcgttcaccgccagcgcgaacatgttgatccagtcgaccaccgccatcggatcggtagaagttttatcaccgctgaccagcatacggcgtaacgccgccgcccggcgcgggacgcgcagtttgcccggcaggacgccttcggtggtaatgccgcgctcaatgccgccgcgcatcacttcccagacgtttgccagatgctgatccagctcggctttgctgcgcagcgccagctcgtttttcatcatcaggccggagagggataagccggtttcctggcaatgacgctgtaaatcggcggcatttttataggggtacggcaccgtgatttctgcattactggtcaggccgaagtgcgcctcatcgacgataaagccgccgccgatggagtaataagtctggctgtaaaccacgctttcacccgccagtgcgctgatacgcatgccgttttcgtgcagggaaaggttatccgcatggaagttcatgcactggtcaaccggaaattccacttcatgctgaccgttcgccagcagcaggcggccatgggtattcacgtcctgaatgaagcccggaatgctgtcgatgtcgacgctgtccggcaggttgcccgccagccccataataatggcgatatcggtatggtggcctttgccggtgagggagagggagccgtaaacatccaccacgacgcgagtgatgtcactgagaatgccacgcgcaatcaggtcgtccgtaaactgtttacctgctttcattggtcccacggtatgggagctggaagggccaatgccgattttgaaaatatcgaatacgctaatcatgatgcattatccgttgctatgagtcagagggcgccgcccgaaaaggcggcgcggggggattagctgaacagggagtagaagatagcggagatagctaccaggcccatgcagacaacgaagatgttgctgatgtgaccgctgtatttgcgcatcgccggcactttctgaatcgcatacatcggcatcaggaacaggatcatcgcgataatcggaccgcccagggtttcgatcataccgaggatgctcgggttcagggttgccacaatccaggtggtcaccagcataaacagcgcggtgattttattcagacggctgatttcgatggttttgccacggctgcgcagggatttgatcaccataccgttgaagccttcacgcgcacccagatagtggccgaggaaggatttagtgatggcgatgatggcgataatcggtgccatccacgcaataatcggcgcgttaaagtggttagccagataagacagaatagagatgttctgatctttcgcagcctgcaaatctgccggcgtcaggctcagcacgcagctgaacacgaagaacattaccgtcagcaccatcatgatgtgcgcgaacgccaggatgcgggagcatttcttctcggcttcatcaccgtactcttcacgtttcgccacggcgaaggaggagatgatcggtgagtggttgaaagagaacaccattaccggaatagcaagccacagggtcatccacaggcctttaccggtactggctgctgcgtcaaaggagagcgtttccagcgcggcaccgctccactgcgggatcaggtacagggccagcagcatcagcgcaaccacaaacgggaacaccagaatactcatcgctttcacgatcatctgctcgccgaagcgcacgatggtcatcataccgacgatcaggatcagggaaagaatgaaacgcggcggcggcgtcatacccagctggtgggtcataaagctgtcaaccgtgttggtgatcgccacgctgtagaccagcaggatcggatagatagcgaagaaatagagcagggtgatgagtttacctgcgccgataccaaagtgttcttctaccacttcagtaatatcttcccccggattttttccggacagcacaaagcgggtcaggccacggtgagcaaaaaaggtcatcgggaaggcgatgatggccatgatgatcaacgggatcataccgccgacaccggcgttgatcggcaggaagagcacacctgcgccgatagcggtgccgtaaaggcccagcatccacatggtgtcagttttacgccatgcgctgcgcgtttctacggcagcaacagtgctggtttgagttgtttccatctgtatctcctggaggaagctaaatatcaggtttttcagtgcaatctaatgaaaagtggcctgacggtaatatgaaatctgttcagcgacggtttttttataatttcttgccgtaactatcggcgggcggaaagatacatttatgtaatgaatgtatcagtgatcccgatcgcaaatgcaataatccgctttctctggggttaatgacaggtcatcccactgcaaagcgatcccaagccaaaattaatggtggcgcaggctaccactgacaatatatgcacgcaaagcatcaaacgaaaaatacgacaaaatcgctgcaaaagatgatgtaaacagcgttttctgaggaatacctgaggtaagaatggatttttagcggtgaaatagcatacgcaaccgtttggcttagggagcagaaataagactggcttataacgggcaggatggctttgcccggcggcgcaggcttgccgggcctacgaaacggataccggatggcagagagtaggccgggtaagcgcagcgccacccggcaaaacagttcaacggccgggtaagcgtaatgtcacccggcatgagaacccgctatcaggtcataatttcatagcagggaatatacgccgagcccggcagcttcatgcggtgctgcgcgacaaagccctgcagcaggtcgtccatgcggcgcatcatgtcgctgtcgccgtggattttgtacggcccgtatttttcaatcgcgtggatccccgcctctttaacgttcccggcgacaatccctgaaaatgcgcggcgcagatcggcggccagaatttccaccggctgatctggatagagcttcaggttcgccatattttcatgggacgggatgaaaggcacctggagttccggcgcaatgcgaattgaccagttaaagctgtaggcatcgccggtctcacgacgattctctttcaccatcggcatcgcttttttcatcagccgcgccacttcatgggcgtcatcaataatcacgcggtaataacgacgcgcgccttcgcccagcgtgttaacaataaattcgtcgagcacgcggaagtagtcagcgctctgttttggcccggtgaggatcaacggcagcacctggtcctggttggcaggattcatcagaatgcccagcagatagagcagttcttccgccgtaccgacgccgccagggaagatgataatgccgtgggcgatacgcacgaaggcttccagacgcttttcaatgtccggcatgatcaccagctcattgaccagcgggttcggcggttctgcggcgataatcgacggctccgtcatgccgataaaacggccttctttgtaacgctgctgcgcatggccgaccgccgcgcctttcatcggcgcttccatcgcccccggcccgcagccggtgcagatgttcagttcacgcaggccgagttgggtgcccacgcgtcgggcgtacaggtattcggtttcgttgatcgagtgaccgccccagcacaccaccatgttcggcgcttcgccgacgtgcagcgcacgggcgttacgcaggatggaaaacaccaggttggtaatgtgggtcgagctttccagatttaaatgctggaaacgaccggcgctgtggatctgtccgttaacgaacagaatgtcgcgcagtacggcaaacaggttggcctgaagcgcgcggatgatacggccatccacaaaggcgtcttccgggggattgatcagttcaagcttgacgccgcgctcacgacgcaaaacgttaatgtcgaaactttcaaaacgcgacagcagctctttgctgttatcggtcagactccctgagttaagaactgccagtgaacagttgcgaaacagctggtacaggtcgctgctggccgtgcgtttaagcatatcgacttccagctgcgacaacatatccattgagcctagcgggctaatatgtgtaatcaagtgagctccttacggggcgaaaatcgccgctccctgtgattacaatagccctggcttatgacgtttaacaacctcatgcgccgattgtgcggcgcaaatgcagaaaattgtctgtttactggcgaaccagtcttccggttgagggcgcaaaatcgccgttggtgcgccacggattaatgtccagaccgccgcgacgggtatagcgcgcatatacgctcagggattctggcttacaaaaacgctgcacatcattgaaaatgcgctccacgcactgttcatgaaattcattgtgatggcggaaggagaccagataacgcagcagcttctcacggtcgatttgcggaccgcgatactggatctgcaccgaaccccagtccggctgatgagtgatcaggcagttagatttcagcagatggctgaccagggtttcttccacaatcgggccgctggcggcgttttccaggtaatcggcgctaaagtcgtagttatcgatcgcaatatcctgatcgtcgatgcacacaccgttgaacgcggcgatcggctgaccttccagttcattaaggcgataaagcgccacgctcacgtcgccctgcgcacaggcgctgagatcgcgctgcagggtggcctgcacctcgtcccagctggcgaaacgcgtctggttgaagctgttgagataaagcttgaagctttttgattccaccagattgacgctggcatagttaagttccacctgtccaaccgccacctgcggcaggccattactgttcagccatgacagctcatagagcgtccagatatcgccgccgtgaaagggcaggttgtcggcatgcaggccgagcggatcgcggttcaggctgcgcggtacgccctgcaacaggctggcgtcgtaggtatcgcggtacgcggtggatttgccgagggtcaggccagccagcgcctggtggttatcataagaagacatgtttcatcgccattttgcaggtaaactatccgccaagtttatcctggctttggttaagagagaaatcggtgcacacagaaacggcgctcgccctgaaagcatttaccgcacgctattgcgatgcctggcatgagacacaccacagctggccgcagagtgaagatttgtacggcgtgccctcgccctgcattatctccaccacccaggacagcgtattctggcagccgcaaccctttgaaggggaacccaatgtaaacgcggttgaacgggcattagatattgtggtacaacccgcgctgcacgcgttttatgccacccagtttgccggtgatatgcccgcgcgctttggcgcgcagacgctgacgctgctgcaaacctggagcgaggacgatttccgccgcgtgcaggaaaatctaattggccatctggtgacgcaaaagcgacttaagatttcgcccacgctgtttatcgccacgctcgacagcgaactggacgttattgccgtctgcaacctgaccggacaggtgattctcgaaaccatcggtacggcgaaacgtacggtgctggccccgtctgttacggaatttcttaatcagcttgagcctgttctgtaatccagattactactgagtttgtgagagatctcttacacaggctgtaggagatcgccaggattttcttctcattcagtccgtcatgctctcccgttaagcccttatattcaacaagttaacctcataaactcccgtctgtgtcgaatgctattctgattatgttcttaagcaccttcttgtaggacagggcaaaaaagcggatccttatccccgttgacaagaggtcacattgcgaagtggatgccgggatggtgtagcttcgcagcaggaacaccaggacggtgctgcaaggaaaggcttccggatgaagcaaagtggatgacgcaggacgcgttaaagtacacctccaggacggagaatgagagccggtcaggatgcccggcggaccaggatgttcagggacgggcgttacggataacgcagatcgtatcggggtggtacgagcaggatgcagttgtttacggatgaacaggtcaggagaccgcaggaaaagttgtcaaggatgagcagggagcaacaaaagtagccggaatgctgcgaaacgaaccgggagcactgtttttacagtgctccctttttttgttcaggcccgactagtgctatcctgcgcgccagttttattttcagtcgaggttgatatgactccccaccagcacgtgcgccaacaactgttcagcctggaaaccctgttaaacgagcagggcatctggcaaacccattccccggtcgccagcgctttcgaaagtaccgagcctttttgtctggataccatggagccgttcgagtggctgcaatgggtgctgatcccgcgtatgcatgccctgttagacagcggacagccgttgccgcagaccttcgccatcgcgccttattatgaagtcgcgcttgatgccagccatccggcccgggatgtggtgctggtacagcttcaacagcttgatgccatctttgctggcgataacgcctgatgctggagatcatctatcaggacgaatggctggtggcggtgaacaaaccttccggctggctggtgcaccgcagttggcttgatcgcgatgaaaaagtggtggtgatgcaaaccgtgcgcgaccagattggtcagcacgtgtttaccgcccatcgcctcgatcgtccgacctccggcgtactgttgatgggcctgtccagcgaggcgggccgcctgttatcgcaacagtttgaacagcatcagatgcagaagcgctatcatgcgatagtacgcggctggctgatggacgaggccgagctggattacccgctgaccgaagagctggataaaatcgccgacaaattcgcccgcgcagataaaggccctcagcccgcggtgacgcactatcgtgggctggccactgccgagatgcccgtcgccaccgggaaatttcccaccacccgttacggactggtggagctgctgccgaaaaccggccgcaagcaccagctacgccgccatctttcgcatctgcgccatccgattataggcgacagcaagcacggcgatttaaagcaaaaccgcagcgccgccgaacacttcggctgtcagcgcctgatgctgcacgccagcgaactgtcgctgacgcatccttttaccggcgaaccgctggtgctgcgtgccgggctggacgaggtctggatgcaggcactgtcgcactttggctggcgggggcttctccctttaaatgaaagggttgagtttgccgcatgcagcggtcaggatgaagagagtcaagtctgaacaaggagtgaatagcatggcagaagtaggcatatttgtcggcaccacctatggcaacgcgctgctggtggcggaagaagcagaagcgatcctgagcggccatggacataaggccaccgtttacgaagatgcagtgctcgccgactggcagcgctaccaggataaaattattctggtgatcacctccaccaccgggcagggggattttcccgacagcatcgccccgttgttccatgcggtgaaagatcagatcggcgtgcagcctgcactgcgctatggcgttatcgccctcggcgacagcacctatacgcacttttgcggcgccggtaaaacctttgatgccctgctacaggaacagaatgcacagcggctgggcgaggtattactcatcgacgccagcgaagatccggagccggaatccgtctctaacccgtgggttgaacactgggctaccttgcttaactaaataaaagccaccctgaaggtggctttttacattcttactcccctttctgttcatttccgtgaagtactccccatagccctgggcttttgcatcaaaccttcaccccacgcctgcgtaatgttgtggggttgcacagtgagtgttcgtagcccgctttttatactttttgagccagatacaaatgcagcgttcaggggaaagcgacctgacagatgaactgcaaaaaataacagcatgatcccgggcaccctaccgctacaccgacgggaaacatgctacgaacatctacgcttcgggagtacaaccatgagttcattaagccacgcggcgagcagtgcggaaaaacgcaccaacgcccgctactggatagtggtgatgctgtttatcgtcacatccttcaactacggtgaccgcgccacgctgtctatcgccggttcggaaatggccaaagacattggccttgatcccatcggtatgggttatgttttctcggcattttcatgggcctatgtgattggccaaatccccggcggctggctgcttgaccgtttcggctccaagcgcgtctatttctggtccatttttatctggtccgccttcaccctcctgcagggtttcgtcgatattttcagcgggttcggcatcatagtcgcgctctttaccctgcgcttcctggtcggactagctgaagcgccatctttccccggcaacagccgtatcgtcgcggcctggttcccggcgcaggagaggggtaccgccgtcgccatttttaactccgcacaatacttcgcgacggtgatcttcgcgccgatcatgggctggttaacccatgaggtgggctggtcgcacgtgttcttctttatgggcgggctggggattatcatcagctttatctggctgaaagtgatccacgaacctaacgaacatccgggcgtaaacaaaaaagagctggaatacatcgccgcaggcggcgggctgatcaatatggatcagaaaggccctaaaacgcatgttccgctcagtcaaaagtgggggcagatcaaacagctgatcggctcccgcatgatgctcggcatctatctcggccagtactgcattaacgccctgacttacttctttatcacctggttcccggtctatctggtgcaggcgcgcggcatgtcgatcctgaaagcaggctttgtcgcctcggtaccggccatctgcggctttgtaggcggcgtgctgggcggcgtaatttccgactggctgatgcgtcgtaccggctcgctgaatatcgcccgtaaaacgcctatcgtgctcggcatgatgttgtcgatggtgatggtgttctgtaactacgttgaaaccgagtggatgatcatcggctttatggcgatggcgttcttcggcaaaggcattggcgcgctgggctgggcagtgatggcggataccgcgccgaaagagatcagcggcctctccggcggactgttcaatatgttcggcaatgtctccggcatcgtcacgccgatcgctatcggctatatcgtcggcaccaccggctcctttaacggcgcgctgatttacgttggtatccatgcgctggtggcggtactgagttatctggtgctggtgggtgacattaaacgtgtcgaactgaaacctgtggcgggacgtgaatgatgaatacacaggcaactcccttaattgccagcatgcgggtgatcccggtagccgggcacgacagcatgctgatgaatatcggtggcgcgcataacgcttacttcacccgcaatatcgtggtgctgaccgataacgccggtaacaccggcgtcggtgaagcaccgggcggcgaaaccatttaccagacgctggtggatgccattccgctggtagtggggcaggaagtggcccgtctgaataaagtcgtacagcgggtccacaaaggcaaccaggccgcggattttgacaccttcggcaaaggcgcatggacgtttgagctgcgcgttaacgcggtggccgcgctggaagcggcgctgctggatctgctgggcaaagcgctgaacgtgccggtgtgcgaactgctcggtcccggcaaacagcgcgatgcggtgaccgtgcttggctatctgttttacgtcggtgaccgcacgcaaacgccgctgccgtaccttgacgcgacgccgggcaatcacgactggtatcgcctgcgtcatcagcacgccatgaccagcgaggcggtggtgacgctggcgcaggcggcgcaggatcgctacggctttaaagacttcaaactcaagggcggcgtactgcccggcgagcaggagatcgaaaccgcacgcgcgctcaagaaaggttttccggatgcgcgtattaccgtggatcccaacggcgcatggctgctcgatgaggccattcgcctgtgtaagggactcaacgatgtgctgacctatgcggaagatccatgcggggcggagcagggcttttccggacgcgaagtgatggcggagttccgccgcgcaaccgggctgccggtcgccaccaatatgatcgccaccaactggcgggaaatgggccacgccgtcatgctcaatgcggtcgacattccgctggcggacccgcatttctggacgctgtccggggcggtgcgcgtggcgcagttgtgcgatgactgggggctgacctggggttgtcattccaacaaccatttcgatatttcgctggcgatgtttacccatgtcggcgcggcagcacctggtacgccaacggccatcgacacccactggatctggcaggaaggcgatgcccgcctgacgaaacagccgctggaaattaagcagggcaaaatcgccgtccctgacgcgccggggctgggcgtggaaatcgactggagccagattgagaaggcccacgagctctacaaaaccctgccgggcggcgcgcgtaatgacgccggccccatgcagtatctcatcccgggctggacgtttgaccgcaaacgccccgtctttggacgccattgattagagtaaaaggatgacagaatgagcaccactacccccgttgttacttccatgcaggtgatcccggttgccggttacgacagcatgttaatgaacctgagcggtgcccatgcgccgttctttacccgcaacatcgtgatcatcaaagataacgccggacagaccggcgtgggcgaaattcccggcggcgaaaaaatccgcaccacgctggaagacgccgccgcgctggtggtgggtaaaaccatcggcgaatacaaaaatatcctcaccgccgtgcgtcaggcattcgccgatcgcgacgccgctggccgcggcctgcaaaccttcgatttgcgtaccaccattcacgtggtgaccggtattgaagccgcgatgctggatctgctcggcaaacacctcggcgttaacgttgccaccctgctgggcgacgggcagcagcgcagcgaagtggaaatgctcggctatctgttctttgtcggcgatcgtaaacgcacgccgctgccgtaccagagccagccggacgacaaatgcgactggtatcgcgtgcgccacgaagaagccatgaccccggatgcggtggtgcgcctggcggaagcggcctatgaaaaatacggctttaacgacttcaaactcaagggcggcgtgctggcgggctttgaagaagctgaggcagttaccgcgctggctaaacgcttcccgcaggcgcgtgtgaccctcgatccgaacggcgcctggtcgctggatgaagccatcgctatcggtaaatccctgcgcggcgtgctggcctatgccgaagatccgtgcggcgcagagcagggtttctccgggcgtgaagtgatggcggaattccgccgcgccaccggcctgccgaccgccaccaatatgatcgccaccgactggcggcagatggggcacacgctgtcgctgcaatcggtggacattccgctggcggatccgcacttctggaccatgcagggctcggtacgggtggcgcagatgtgtcatgaattcggcctgacctggggttcacactccaacaaccatttcgatatctcgctggcgatgttcactcacgtggcggccgcagcgccaggcaacatcaccgccattgatacacactggatctggcaggaaggcaatcagcgcctcactaaacagccattcgaaattaaaggcggcatggtgcaggtgccgactacgccgggcctcggcgttgagctggatatggatcaggtgatgaaggcgaatgaactgtatcagaagcatggcctgggcgcgcgcgacgacgccatgggcatgcagtacctgatccccaactggacttttgataacaaacgcccctgcatggtgcgttagtgcaaccccgccggttcttgcgggaaccggcgctttcccgtgtcgggaaagataatactggcagtcaacatacctaaggacagcatatgaaaatagtgatcgcaccggactcatacaaggaaagcctgagtgccctcgatgtcgctaccgccattgaacgcggttttaaagagattttcccggacgcggagtacgtcaaactgccggtggcagatggcggcgaaggcacggtcgaagcgatggtggctgccacccacggcagaaaagtgcaggttaaggtgaccggcccgctcggcgaaccggtagcgggtttttacggtctttccggcgatgagcggagcgcctttattgaaatggccgccgccagtggtctggaactggtgcctgcggcaaaacgcgacccattaattacaacatcctgggggacgggcgagctgatccgtcacgccctcgacgcgggcgtgaaacatattattatcgggcttggcggcagtgccaccaatgacggcggcgccggaatggtacaggcgctgggcgcgaagctgttaaatgcgcaggggaagtcgctggggcagggcggcggcgaactggaaacgctggcgcgcattgacgtcagcgaactggatgcgcgcctgaaaacctgccgcatagaagtggcctgtgacgtgaccaatccgcttacgggtgaccagggggcatcggcgattttcggtccgcaaaaaggcgcgacgggcgaaaccgttgcccgtctggaccacgcgctgcaccattatgcgacgatcattcagcgcgatctggatgtggatgtgctgacgctggcaggcgggggcgcggcgggcggcatgggggccgggctgtacgcattttgcggcgcggagctgcgtcgcggcattgagatcgtcaccgacgcgctgcatctggcggagcacgttgccggtgccgatctggtgatcaccggcgaagggcgcatcgacagccagaccgtgcacggcaaagtgccggttggtgtggcgaaggtcgcgaagcgttataacaaaccggtaattggtattgccggcagcctgacggcagacgtggggatcgtccatgagcacggactggacgcggtattcagcgtcatctacaccatttgctcactggacgacgcgctgaaaaatgccggggaaaacgtacgcatgaccgcgcgcaacgtcgcggcggtgttaaaggccgggcggggattaccgccgtcagcctgacaacgtctccctctccctgcgggagagggccggggtgagagggagtattatcccaggatcttactcgcttcccgccccacgttatccatctcatccagcagttcgaggaattccggctccagatccgcggcgggcgttccgctgcgtaactggtgctcaatcagatggcagagatttttcagccgtggcacgccgctgtagccacagctgccatgcagcttatgaatggcctccgtcagtccttccggcgcttctcccaccagttgttcctccaccttattgcggatctccggcaggaaatcgagcagcatctgtaacatttcccgcgccagatcgttctttccggcggcctgacgcagcgccagctgccagtcgagggtggcgttcgggttgaccgtggctgccaccggctcaggaagcggctgcggctcaggcggcgtcagccactggctcacgccggggccgggcagatagcgcagcagcaggctgcgtaacttatcttcttcgatcggtttcgccagatagccgttcatgcccgcgctgaacagcttctctttctgatcggcgagggcatgggccgtgaccgccactaccggcgtctgctgctggtgcggcaactggcggattaactcgcaggcgcgaatgccgtccatttccggcatctgaatatccatcaggatcaaatcgaactgcatctgccgcgcccggtcaacggcctgttgcccgctttcgcacagttccacctgctgcacctgatcgtcaagcagcgcgccgatcagcttcaggttggcgggattatcatctaccgccatgacgctcatcgccagcttatccgcgttctccagcagcggcggcgcacggcggttcaggcgacaatattcattgagcgcgggcagcagtcgcgccgccgttaggggcttgagcagacaggccgccgcgccattttgtttcagctcttcggcgttaatttgcgcatggcagggcagcgccagcagcaggtaatcggtcatctgcgacgccttcgccagccgggtatgctgcatggtcagcggctcctgcagggtcaccggcaccgccagtagcagaatatcgtaatgatcttccggcagccctgacagcgtcgggctgtagatcacctccagcggcgtactgctgagtaaatccagcgtgctctgcgccgccgccgtgttcggctcaatgtaggccagccgtttacccgtaaggcacagcgttgatggcccttcgccgatgacgtttggattgagatcgagattgatgtggaaccagaaggtggacccacgctgcggctggctgtggaaagagatatcgccgcccatttcattaaccagtttttgcgtgatcaccagccccagcccggtaccgccgtgtcgccgcgaaatactcgcatccgcctgacggaacgcctggaacagccgcgactgatcccgctcgggaataccgataccggtatcgcggatctgcacctcgatctgcactttgttattactgatggagcgtttttccaccaggatgtctatgttgccgttttcggtgaacttaatggcgttacccaccagattagtgatcacctgttgcaggcgcagaggatcgccaatgacattgtccggcacgtcgttcttgatgttcagcgtcagctcaaggcccttatcatgcgcggcatgagccagcagcgtcaccacttcgtccagcgcgttgcgcagcgggaagggaatgctttcaaggatcagcttaccggcttcaagcttcgagaaatccagcacgtcattgatgatggtcagcagattattggccgagcgctcaatggtatgcagatgatctttctgggtgggcgtcagctcggatttcagcgtcaggcgggtaaagccgatcacgccgttaagaggcgtgcgcagctcatgagacatgttcgccagaaactctgacttgatgcgcgccgcttcctgcgcccgttttttcgccagatccagctcaacgttctggatctccatctgctccagcgtttcccgcagatcggaggtggcctgatcgatattgtgctgcatctcctcgtgataggccgccagcgacatcgccatcgaattaatgccgtttttcagcatatccagctcgccgagcatgaagccttccacgcggctgtccagctgaccgcgacggatgcgatcaacggtattgaccatattgcggatcgggccggtgacgtcgcgcatcagccgccagccaaagatcagggcgatgccgatacagaacagcatcatcaccgaggagacaaaaatctctttgtactgctgcaggcgcacggaacgcagatccagctccagcgccacatagcccaacatattattcgcctgcttggcatccgccgtggaagattcgtcaggtgaatacctttctgagataatcggcgtacgcaggatcataaaatcgccgttgcgcaccacgctcaagcggcgcgggaaaggcgtgcctttcgacagttttagctcgtccgggtcgagatggaaatttgaggtaacaaacagattgttacgctcatcgtaaatggagatcgcccgcacgatgtccgaatggcgacggtgcaacacgctgatgagctgcccgatagactcacggttttgcagattcatgccgtattcgctggagacggcgagcggctcaataatgctggcgccggcgtcttcaagctgacgctgtaagtcattgtagcggtggacaacaaagaagatgctgagcaacaaaccgatcagtacggtgggggccagaatcaaaatcatcatgcgcgcgcgcaggctgtagttggtcatggagttccgttatgggacaattagggcaattatgtttgattgagaaaattcccggcaatggcgcaattctactctgcaaaacgacgcgtggcgacgcgtcagatcataactgttgaagtgagcgacctcgatcctttcggtcagggcgtggctcgtcacaacggtaaagcgctgtttatccccggactactgcccggcgaacgggcggaaatcatggtgacggaagacaaacgtcaatatgctcgcgggcaggttaagcgtcgtcttaacgacagcccggaacgggaaacgccgctgtgcccgcattttggcgtctgcggcggctgtcagcagcagcacgccagcgtggcgctgcaacagcgcagtaagcgcagcgcgctggcccgcatgatgaaacgcgaggtggacgaagtgatcgccgaccagccctggggctatcgtcgtcgcgcgcgcctgagcctgaacgtggcggcaaaaagccagcgtctggaaatgggttttcgcaaagcgggttcaaacgacatcatcgacgtgaagcgttgcccgattctggtgccccgtcttgaggcgctgctgccatcattgcgcagctgtctgcagacgctggacaatccgcaccatcttggacacgtcgaactggtgctggccgataacggcccgctgctggtattgcgtcataccgcgccattaagcgccaaagatcgtgaaaaactggaacgcttttcgcattccggggacgtggcgctgtttcttgcgccgcaaagcgacatactgcaacccgtaaccggcgaggcgccctggtacacctcggacgggctacgcttaaccttcagcccgcgtgatttcattcaggtgaatgatggagtgaatcagcagatggtggcaaaagcgctggcgtggctggacatttcccctggcgatcgggtgctggatctgttctgcgggatgggcaattttaccctgccgctggcgaaacgcgctgcaagcgtggtgggcgtggagggtgtcgcggcgctggtggaaaaagggcggcaaaacgccgaacagaatgcgttgcacaatgtgacattttttcatgaaaacctggaagaagatgtcaccacgcagccctgggcgcgccacggcatagacaaagtgctgctcgatccggcgcgcgccggtgcgccgggcgtcatgcagcacataataaaacttgccccgtcaaaagtagtctatgtttcctgtaacccggccacgcttgcccgcgacagtgaagcattattaaatgcggggtaccagattcagcggctggcgatgctggacatgttcccgcacactgggcatctggaatctatggtgttatttgcacgcagtgtgagcacaggtaattaacttcggcttgtcgaattcgacaggcttcgtccctgaaaggagaggacaatggttgcggtaagaagtgcacatcttaatcgggcaggagaattcgattctgaaaaatggatcgccagtctgggaatttccagtcagccctcgtgtgaccgcttagccgaaacctgggcgtactgcctgcaaaaaacccagggccatcctgacgccgatctgctgttgtggcgcggcgtcgagatggtggaaatcctctccatgttaagcatggatattgaaacgctgcgcgcggcgctgctgtttccgctggcggacgccaacgtcgtcagcgaagacgtactgcgcgagagcgtcggtaaagccattgtcgatttgatccacggcgtgcgcgatatggccgctatccgtcagctgaaagccacgcacaacgactccgtttcttctgaacaggtggataacgttcgccggatgctgctggcgatggtcgatgatttccgctgcgtggtgatcaaactggccgagcgcgtggcgcatctgcgggaagtgaaagatctgccggaagatgaacgcgtactggcggcgaaagagtgcaccaatatctatgcgccgctggcgaaccgcttaggtatcggtcagctgaaatgggagctggaagattactgcttccgctatctgcatccggatgaatacaagcgcatcgctaaactgctgcatgagcgccgtatcgatcgtgaacattacattgatgaatttgtgggtcatctgcgcgcggaaatgaaaaccgagggcgtgaaggccgaggtgtacggccgtccgaagcacatctacagcatctggcgcaaaatgcagaaaaagcagctcgcctttgacgagctgtttgacgtgcgcgcggtgcgtattgtggccgagcgcctgcaggactgctatgcggcgctgggtatcgtacatactcattatcgccatctgcccgacgagtttgacgactacgtcgccaacccgaaacccaacggttaccagtccattcacaccgtggtgctggggccggggggcaaaaccgttgagatccagatccgtacccgtcagatgcatgaagatgccgaactgggcgtggcggcgcactggaagtacaaagaaggggcagccgcgacaggcgcgcgcgcgtccggccacgaagatcgcattgcctggctgcgtaagcttatcgcctggcaggaagagatggccgactccggcgaaatgctcgacgaactgcgcagtcaggtgttcgacgatcgcgtttacgtctttacgccgaaaggcgatgtggtcgacttaccggcaggctccacgccgctcgacttcgcctaccacattcacagcgacgtcggccatcgctgcatcggggcgaaaatcagcggacgcattgtgccctttacctatcagcttcagatgggcgatcagatcgaaatcatcacccagaagcagccgaaccccagccgcgactggctgaatcctaaccttggctatgtcaccaccagccgcggacgggctaagatccataactggttccgcaaacaggatcgcgataaaaatattctcgccgggcggcagatccttgatgacgagcttgaacatctggggatcagcctgaaagaggcggaaaaacagctgctgccgcgctacaacttcaacgaagtggaagagctgctggcggcgattggcggcggcgacattcgccttaaccagatggttaacttcctgcaggcgcagtttaataaaccgagcgccgaggaacaggacgccgctgcgcttaaacagttgcagcagaaaacctgggcgccgccgcaccgtaacaccaacaaagataaaggccgcgtggtggtggagggcgttggtaatctgatgcaccacatcgcccgctgctgccaaccgatccccggcgatgagatcaccggttttatcactcaggggcgcggcatctctattcaccgcgccgactgcgatcagctgaccgaactgcaatcccacgcgcctgaacgtattgtcgacgcggtatggggcgagagctactcggcgggctattcgctggtggtgcgcgtgaccgctaacgatcgcagcggtctgctacgcgatatcaccaccattctcgccaatgagaaggtcaacgtgctgggcgtggcaagccgtagcgacaccaaacagcagctggccaccattgatatgaatatcgaaatctataatctgcaggtgcttggccgcgtcctcggtaaactgaatcaggtgccggatgtgatagacgcgcgtcgcctgcacggcggttaattttactttttcggcccgatggcgaattgctgtcgggcctgtgttttcaggacattccaatgacgcaaatcgatcgcctgctgggcatcatgcaacgcctgcgcgacccggaaaacggctgcccgtgggataaagagcagacctttgccaccatcgccccttacaccctcgaagaaacctatgaagtgctggacgccatttcccgggaagattttgatgatctgcgcggcgaactgggcgatctgctgttccaggtggtgttttacgcgcaaatggcgcaggaaggggggcgttttgacttcaatgacatttgcgcggcaatcagcgacaagctggaacgccgtcacccgcatatctttggcgatgccacggcagaaaacagtactgaggtattagcgcgctgggagcaaattaagcacgaagagcgcgccgaaaaagcgcagcattcggtgctggatgacatcccgcacagcttcccggcgctgatgcgcgcgcataaaattcagaagcgctgcgcctcggtcggctttgactgggccaccctcggcccggtggtggaaaaagtttacgaagagatcgatgaagtgatggacgaggcgaaacaggcggtcgtcgatcaggcgcgggtggaagaagaaatgggcgatttgctgttcgccaccgtgaatttatcccgtcatctgggcgtcaaagcggaagtggcgctgcaaaaagcgaacctcaaatttgagcgtcgtttccgggaagtggagcgtattgttgctgcccgcgggctgagcatgaccggtgttgatctggaaaccatggaagaagtctggcagcaggtaaagcggcaggaatctgatctctaacgacttttgcggatcaagcgcgatttgtgtgattttttaaataacaagcgcttgatttgcgtcaaaaacatttagccaaaaggggctattttctcactccttattattgtcagaacctgtggaagaggaggaagaatgaaagtttgtggcaactgcccggttccggtatactgctttcccgtcctggttattccatcgtcttttaaacctaacttctcaggttcagcatgacaacgaactatatttttgtgaccggcggggtcgtatcctctctgggaaaaggcattgccgcagcctccctcgcagccattcttgaagcccgtggcctcagcgtaagcattatgaaactggatccgtacatcaacgtcgatccgggcaccatgagcccaattcagcacggggaagtgttcgttactgaagacggcgctgaaaccgatttagacctgggccactacgagcgcttcattcgcaccaaaatgagccgccgtaacaacttcactaccggtcgtatctactccgacgtgctgcgtaaagagcgccgtggcgactatctgggcgcgaccgttcaggttattccgcacatcaccaacgccatcaaagagcgcatcatcgaaggtggcgaaggctacgacgtggtgctggttgaaatcggcggcacggtaggcgacatcgaatccctgccgttccttgaagcgattcgccagatggccgtggaagtgggccgtgaacacaccatgtacatgcacctgacgctggtgccatacatggcggcggcaggtgaggtgaagaccaaaccgacacagcattctgtgaaagagctgctttctatcggtatccagccggatattctgatttgtcgctcagatcgcgcggttcctgccaacgaacgtgcaaaaattgctttgttctgtaacgttccagaaaaagccgttatttctctgaaagacgtcgattctatttataaaattccgggcctgttgaaatctcagggactggacgattatatttgtaaacgattcagcctgaactgtccggaagctaacctgtctgaatgggaacaggttatttacgaagaagcgaatccggcgggtgaagtcaccatcggcatggtcggcaaatacattgagctgccggatgcctataaatcggtgatcgaagcgctgaaacacggtggtctgaagaaccgcgtaaccgtcaacatcaagctgatcgattcgcaggatgtggaaacgcgcggcgttgagatcttaaaaggtctggacgcgatcctgatcccgggtggtttcggctaccgcggcgttgaaggtaagatcgccactgcacgctttgcgcgtgaaaataatattccttatctgggcatttgcctgggtatgcaggttgcgctgattgagtttgcgcgcaacgtagcgggaatggacaacgccaactcaacggaatttgtgccagactgtaagtaccctgtcgtggcgctcattaccgaatggcgtgatgaagatggcaatgtcgaagtccgcactgaaaagagcgacctgggtggtacgatgcgtctcggcgcacagcagtgccagttggatgacgacagcctcgttcgtcagttgtacggtgcgtctaccattgttgaacgtcaccgtcaccgctatgaagtcaacaatatgctgttgaaacaaattgaagctgcgggtctgcgtgtcgcgggccgttccggcgatgatcagttagttgagatcatcgaggtgccaaaccatccgtggtttgtcgcctgtcagttccacccggaatttacttcaacgccgcgtgatggacatccgctgtttgcaggctttgttaaggccgcaagcgatttccagaagcgtcaggcgaagtaagagttagaacgacaatgcaccctgccgggtgcattgtttgtctggagttttagtttaacttgtactgaggaaatcctaatgtccaaaatcgttaaagtcatcggtcgtgaaatcatcgactcccgtggtaacccgactgttgaagccgaagtacaccttgaaggtggtttcgtcggtatggctgctgccccgtcaggtgcttctactggttcccgtgaagctctggaactgcgcgatggcgacaaatcccgtttcctgggtaaaggcgtaaccaaagcggttgctgcggttaacggcccgattgctcaggcagtgcttggcaaagacgccaaagaccaggctggtatcgataagatcatgatcgatctggacggtactgaaaacaaatctaacttcggtgcgaacgctatcctggctgtgtctctggctaacgccaaagccgctgcggcttctaaaggtcaggcgctgtacgagcacatcgctgaactgaacggcactccgggcaaatactccatgccggttccgatgatgaacatcatcaacggtggcgagcacgcagataacaacgttgatattcaggaattcatgatccagcctgttggcgctaaaacgctgaaagaagctgtgcgtatgggttctgaagtgttccacaacctggctaaagttctgaaagctaaaggtatgaacactgcggttggcgacgaaggcggctacgcgccgaacctgggttccaacgctgaagcactggctgttatcgctgaagcggttaaagcagcaggctacgaactgggcaccgacatcactctggcgatggactgcgcagcgtccgagttctacaaagacggtaaatacgttctggccggcgaaggcaacaaagccttcacctctgaagaattcacccacttcctggaagatctgaccaaacagtacccgatcgtttccatcgaagatggtctggacgaatctgactgggatggtttcgcataccagaccaaagtgctgggcgacaaaatccagctggttggtgacgatctgttcgtaaccaacaccaagatcctgaaagaaggtatcgaaaaaggcatcgttaactccatcctgatcaaattcaaccagatcggttctctgaccgaaactctggctgcgatcaaaatggcgaaagacgctggctacaccgcggtgatctctcaccgttctggcgaaactgaagatgcgaccattgccgacctggcagtaggtaccgctgcaggccagatcaaaaccggttccatgagccgttctgaccgcgttgctaaatacaaccagctgatccgtatcgaagaagcgctgggcgaaaaagcaccgtacaacggtcgtaaagagatcaaaggccagtaattctgccttttaatctgattgataaatgccagtctacggactggcatttttttacctattttttgcgaagttccgggcacgaaccaataaatgtgagttatatcaagctaaaatttttatttgcagtgtagtttagcaataataatatatagtgttattggtgcagtgaattagtatttgataaggatagttttatattatggatgatgatgaaataaaaatattcatgattaaatctggagtgaaaaaaagagaggctgcttttctgattaaattggcaaaaaggaaaaagatcagcataggaagggcattctttctctatgtatggaaatattatgcctggagtggtgtattgttattatctgtgatttttggctcgatagctggtggagtggagtcctttttagttaactttcttttttgcagcgtgattgcttttttatccttattctttacacctttttttatgaatttagtatggagtattaaaattcaggttaagttgattgggaaatgacaggaggttttaatgtgcagttatggactaatgaatttgcagcgtgaagaagagaaagttagtaggcttgtatttgacattggttttaaatatttacatggaatcaaattacgttcgagatttatgtgtgaagagaattctctttcgaaagaatatattaatgactatctttcaggaaaaataattttttctgaagcaatgaaccggttacgaagtcagtatgaacgtttgattcgaaaccaaagccaattacagatgggaagcataaagttatatgctatcgcagagcgcgaaaaagacaggcattcgcttttaacgattacgctcaagcgagtgggttttgttagtggctcgatgcaggcaatcgggggattcggaatatgcaaggcgaatattggagctgcatgtagatattttggtgttcctttaatgatccagggaagtgaaaatgtctgggagaatggctactacttgctttatcacgaggatccaaaagtagtgcctgtacgttatgcttatcggcaggctgctaagtttttcggtggtgaaggaagggatggtgacatcgctttttcaagtggagatattgccctttctctcgggtcggcatcgacattgacattaaagtctgattcatggaaattattccactatattcgggaggattatatccataactggagaacattgggcgctgtcggcggaatcaatgaattagcgggtgatgcagccagtggattttctatttatcagattgcgggagtggggagtacaaactgggaggcgttggggaggtaaacagatgcatgaaaaaaaatatgatccgaatgatagagatttagtcgaaagggtaatgaacacaggattaagtgaatataaaacgcaaaaaattattaacgctgccaatgcaaaagggttaagcttacaaaaaacgtatcggctaacggaagcaagaatattcagcgtagatgtcattattgctacgattatgcttttttttattatctcgatagtgttactcgatcctggcgctttgtgggtgttcatttttgtatttgggcttctatttataacgattgaagtagtagttcggtctcataaaaattactggaagatgttgaaaatctatcacggtcttagggggttatgaaaccttcttctatacagaatcattataatagatgttctttacctcaattatagtgaatgcgtgctgatataaaagagaggaattctgcaaaaaccaatagtgactcatatcgaatttgtagtcttccccaatgtattagcgttctacagcagcagcggtaaggtcgcgctggcggtttgctggctggtatcgctgtaatgcgcgtcataagacattaaagcagtgatcagcagttccaccagcagcatggcccccactttggcattcagcgccccggcgctgagcggcccttcaggtttcgccgccaccagcagcatatcgctgatcgacgccagcggactgcgcggcgtattgcttaacgccagcaccgtcgcaccacgtttacgcgccagtttcaccacatgcagcagatcgcgcgtggagccggaactggagatcgcgatcaccagctcatcacttcccagcgtggtggcattcatcgccgcgcgatgcatatcgctgaacagctgcgccgttttgccgaggcgtaaaagtttgtagtgcagataatcgccaatgatggcgctggccgccacgccgtaaatctgcactgtgcgcgcctgatgcagtgtcattgccgccctggccagcacctcgcggtcaagcagcctcgacgtatcccgcagcgccatgaccgactcttccaccagcgtatcaatctcatcgccctgctcacgcggcgtcccggcgcgctgcacatccagcgccagcgccattttgaattccgtatagcctttgcagcccagcacacgacacaggcgcgtcacgctggcttcgctggtggcgctctcccgcgccagctcggtgatggtctgataaagcacccgcgaaggttctgccagtatgtattccgtcagcttctgctgcgtggggctgtaacccgacattccctggcggaggcgcagcagcacattttcattttcagacattccgggatcctttacgtcgttaatgcccgatagtgtggcggaaagaggggacaggttgccagtcattttaaaatagtatgatccgcttccgcttttttggtgataattttcacgttaaatatttattgtggtaaaaattttcatcaacaagcagcgagcggagatagagtatgacaatgttcagtggtgcctcccccgggggctggtttgaaaaagcgcagcgttttggtaaatcttttatgctgccgattgccgtacttccggcggcggggctgctgttggggattggcggcgcgctgtcgaatcccaatacgctgacggcctggcctttcctggatgtggcctggctacaggcgattttcaccatcatgagcagcgccggggcgattgtttttgccaacctgtcggtactttttgcggtgggcgtggcggtggggctggcgaaaaccgataagggcacggcgggactggccgcgctgctggcgtatctggtgatgaatgccaccattaatgcgctgctgacgctcaccggtacgctggcgagcagcaatcccggcgcggtcgggcagggcatgaccttaggtattcagacgctggaaaccggcgtgtttggcggcgtggtcatcggcctcgtcacctgcgcgctgcatcaccgctttaataagatcgcgctgccgcagtttctgggcttttttggcggctcgcgctttgtacccattatcagctcgctggcggcgatccttgtcggcgctatcatgacggtggtctggccgcattttcaaaagctgattttcggtcttggcgggctggtggatgccaccggctacctaggcacttttctctacggctttattttgcgcatgcttggccccttcgggctgcatcacatcttttatctgcctttctggacgacggcgctgggcggcagcgagatagtcaacgggcaactggtggaaggcacgcagcgcattttcttcgcgcagctggccgatcccgcgacgcagcagttttacgaaggcacctcacgctttatgtccggccgcttcatcaccatgatgttcgggctggtgggggcatgtcttgcgatgtaccacaccgcgaaacccgaaaacaaaaagcgggtagctggcctgctgttctcggcggcgctgacgtccttcttaaccggcattaccgaacctattgagttttcgttcctgtttgtcgcgcctgtgctgtacgttctgcacgcgttgttcgacgggctggctttcatgctggcgcatatgctgcatatcactatcgggcagacattttccggcggctttatcgactttgtgctgttcggcattatgcagggcgaagcgaagacccactggctgtatgtgccgctggtcggcattccgtggttcttcctgtactacttcacctttcgcttcctgattaagcgctttaacttcctcacgccaggccgcgaaaaagagcaggcggaaatcgctgccgtcagcggcaccgaacgggcagaagccatagtggcggcgctgggcgggcgcgggaatctggacgaggtcgactgctgtgccacacgcctgcgcgtaacggtaaaagcgggcagcaaagtggatgaagccgccctgaaagcgacaggcgcgcgcggggtgatcgttcgtggtaacggggttcaggtgatttacgggccgcacgtcaccatcatcaaaaacgaaatggaagagatgttagcgttatgaatgcattagaacagatcaaaaaggcgctggtggtgtcctgccaggcgctggaaaacgaaccgctgcacagcgattttattatgtcccgcatggcgctggccgcagtggaaggcggtgccgcaggtattcgcgccaacagcgtggtggatatcaaagccatcaaggcgcaggtgtcgctgccggtgatcggcattatcaagcgtgattaccctgacagcgacgtgtttatcaccgccacgctgcgcgaaatcgacgagctgatgacggtcgccccggaaatcatcgcgctggatgccacccagcgtaagcggcctggcggcgacaccctggccgcgctggtcagtgcgatccgccgccgttatccgcaggtcttgctgatggcggatatcgccaccctggatgatgcgcgtattgccggtgagctgggctttgactgcctcggcaccaccctttatggctatacggctgaaacggcgggacgccggctaccggaaaacgatctgcaatttttaaaagaggtactttccatcgccactatcccggtgatcgccgaaggcaatgtcgacacgcctgagcttgccgcgcagtgccttgcgctgggggcgcattcggtggtggtgggcggcgccatcacccggccgcagcaaattaccgcgcgttttacccgcgcgattaatgcgcagggcgcgaatggcacatgatcgtctggccgggatctgcgatacttagggtttagatcctgaacagagatgagtatgcagtacccgattaatgaaatgttccagaccttgcaaggcgagggttactttaccggcgttcctgccatttttattcgtttgcagggatgcccggttggctgtgcctggtgcgacaccaaacacacatgggacaagctctccgatcgggaagtgtcgctctacagcgttatcgccaaaaccaaagagagcgataaatggggcgcggcgagcagcgaagatttgctggctattatcagccgtcagggttacaccgcgcgtcatgtggtgatcaccggcggtgagccctgcatacacgatctgctgccgctgacctcactgtttgagaagaacggttttagctgccagatcgaaaccagcggcacgcacgaagttcgcaccacgacgggcacctgggtcacggtatcgccgaaggtaaatatgcgcggcgggtatgacgtgctgacgcaggcgctggagcgcgccgacgagatcaaacatccggtaggccgtgtgcgggatattgaagcgctggatgaactgctggcgcgtcttgacgatgacaaaccccgcgttatcgccctgcaacccatcagtcagaaagaagacgccacgcgtctgtgcatcgaaacctgtattgcccgcaactggcggctgtcgatgcagacgcataaatatctgaacatcgcctgaccagacgccctctcccacgggagagggtgatatgacaggagatcactccccgcgataaatacagcccgccgtacaggtttctttcaccatcaccgcgctcagctgcggcaccagcggcttcatttcgttccagatccacgcggccagcacttcgctggtcgggttctcaagccccggaatatcattcagataatagtgatccaggcggtcatatgtcggcttaaacgcgcgttttagctcggaaaaatccatgatccagccggtatgcggatcgacttcaccggtaatttccaggcgcaccataaaagagtgaccgtgcaggcgaccacatttatggccttccggcacgtgcggcaggtgatgagcggcttcgaaggtgaaatctttaaacaaggtggtgatcattatcatttctctgtaaggcaaaaaccgccgtagggtagcggatatgaccttttttagcattaacaaaaaccggtaaaagtgtttaaccaaagtatttgtcagggttatgggttttttattattaaaattcaaagatttaattgaccggttttagtgttaataactatagctaaaagaggttagtcattttggttatttgttatttccaacccttctttagttgttattattcgcgccgttaaccttactctctgttctgtttttcccccttataaaaacggcttttactggaactggacgacgcatgacgactcaggccccaccttccgctttgctgccgcttaacgcggagcaaatgtcgcgcctaacggcggtgacatccgaacttactccgactcagcttgcctgggtttccggctatttctggggcgtgcttaatcagcagcctggaaccgttgcgggcacaaccacgcctgccgcgcctgccgcgaaagaaacgccagctatcacgctgatttccgcctcgcaaaccggcaacgcccgccgcgtggcggaagccctgcgcgatgatctgctggcggcgaagcttaacgtcaacctggtgaacgcgggcgactataaattcaaacaaatcgctcaggaaaaactgctggttgtcgtgacctccacgcaaggggaaggggagccgccggaagaagccgtcgcgctgcacaagttcctgttctcgaaaaaagcgcccaaacttaacggtacggccttcgccgtatttggcctgggcgattcctcttatgaattcttctgccagagcggcaaagattttgacagcaagctggcggagctgggcgctgaacgcctgctcgaccgcgttgacactgacgttgaatatcaggccgctgccgccgaatggcgcgggcgcatcctggacgttctgaaatcccgcgttccgcaggaaagcccggcgcaggctgcggctaccgccagcggcgtggtcaacgaagtcacttccagcccctatactaaagaagcgccgctttgcgccacgctgtcggtcaatcagaagatcaccgggcgcgattccgaaaaagatgtgcgtcatctggagatcgatctgggcgactccggcctgcgctatctgccgggcgatgccctgggcgtgtggtatcagaacgatccggcgctggtcaaagaactggttgaactgctgtggctgaccggcgacgaacaggtgaatgttgatggcaaaactctgccgctgtccgaggcgttgcaatggcattttgagctgacggtgaataccgtcaacatcgtggaaaactacgccaccctgacccgcagcgaaacattactgcctctggtgggcgataaagcgaagttgcagcactacgccgcaacgacgccgattgtcgatatggtgcgtttctccccggcgcaactggatgccgacgcgcttattggtctgctgcgtccgctgacgccgcgcctgtactccatcgcctcgtcccaggcggaagtggaaagcgaagtgcacattaccgtgggcgcggtgcgttttgacattgaaggccgcgcgcgggctggtggcgcctccagcttcctcgccgatcgcgtggaagaagacggcgaagtgcggatctttatcgaacataacgataacttccgtctgcctgaaaacccggaaacgccggtgatcatgatagggccgggtaccggcatcgcgccgttccgcgcctttatgcaacaacgtgctgccgatgaggcccccggtaaaaactggctgttctttggcaatccgcactttacggaagactttttataccaggtggagtggcagcgctacgttaaagacggcgtgctgaaccgcatcgacctggcctggtcccgcgatcagaaagaaaaaatatacgtacaagacaaactgcgcgaacagggcgcagagctgtggcgctggatcaatgacggtgcccacatttatgtctgcggcgacgccaatcgtatggcgaaagacgttgagcaggctttgctggatgtgattgccgaattcggtggcatggataccgaagcggcggatgaatttttaagtgagctgcgcgttgagcgccgttatcagcgagatgtctactaatgagcgaaaaatatccaggtccgctggtggtcgaaggaaaactgactgacgccgagcgcatgaagcgggaaagcaactatctgcgcggtactattgcggaagatttacataacggtctgaccggcggtttttccggtgacaacttcctgctgatccgttttcacggcatgtaccagcaggacgatcgcgacattcgcgccgaacgcgccgagcagaagctggagccgcgccacgcgatgatgctgcgctgccgtctgccgggcggcatcattacgccgcagcagtggctgtcggtggataaattcgccaccgaaaaaaccatctacggcagcatccgtctgaccaaccgtcagacgtttcagtatcacggcatcctgaaaaagaacgtcaaaccggcgcaccagatgctgcacgaagtggggctggacgcgctggcaacggcgaacgacatgaaccgtaacgtgctttgcacctctaacccggtggaatcgcagctgcacgctgaagcctacgaatgggcgaaaaagctctctgagcacctgctgccgcgcacccgcgcctatgcggaaatctggcatgatgccgagaaagtggcgaccaccgacgaagaacccattctcggtcagacctacctgccgcgtaaatttaaaacgacggtggtgatcccgccgcagaacgacatcgatctgcacgccaacgacatgaactttgtcgccattgccgaaaacggcaagctggtgggctttaacctgctggtaggcggcggattgtccattgagcacggcaacaagaaaacctacgcccgtaccgcgactgaattcggcttcctgccgctggagcatacgctggcggttgccgaagccgtggtcaccacgcagcgcgactggggcaaccgtaccgatcgtaaaaatgccaaaaccaaatacacgctggagcgcgtcggcccggacgtcttcaaagcggaagtggaacgtcgcgcgggcattaaattcgcgccgatccgcccgtatgaatttaccggtcgcggcgatcgtatcggctgggtgaaaggcattgatgataagtggcacctgacgctgtttatcgagaatggccgtatcatggattacccggatcgtccgctgaaaaccggtctgctggagatcgcgaagatccacaaaggcgacttccgtttaaccgccaatcagaacctgatcgtggcgggcgtaccggaaagcgacaaagcgaagatcgaaaagctggcgcgcgatcatggcctgatgaacgccgtgaaaccgcagcgcgaaaattccatggcctgtgtcgccttcccgacctgcccgctggcgatggcggaggccgagcgtttcctgccgacctttatcgataaagtggaagcggtaatggaaaaacacggcctcggccatgagcatatcgtgctgcgtgttaccggttgcccgaacggctgtggccgtgcgctgctggcggagctggggctggtcggtaaagcgccgggacgctacaacctgcatctgggcggcaaccgtatgggcacgcgcatcccgcggatgtaccgtgaaaacatcaccgaaccggaaattctcgacaccatcgatgaactggtggggcgctgggcgaaagagcgcgatgccaacgaaggcttcggtgatttcaccgttcgtgctggcatcatccgtccggtgctggatccggcgcgggatttctgggaataacgtaacacgccggatggcggcgtgaacgccttatccggcctacagggctaaaccgtaggccgggtaagcgtaagcgccacccggcacacccgccattctgtaggccgggtaagcataagcgccacccggcataagtgaggaatctatgtccgtactcgatctaaacgcgctcaacgatctgccaaaagtagaacgcgtactggccctcgccgaaacgaacggccagcttgaaaaactcagcgcagaggagcgcgttgcctgggcgctggaaaatctgccgggcgaatatgtgctgtcgtcgagctttggtattcaggcggcggtcagcctgcatctggtgaatcagatccgcccggatattccggtcatcctcaccgataccggctacctgttcccggaaacctaccagtttattgacgagttaacggacaaactcaaactgaacctgcaagtgtatcgcgcgaaagagagcgccgcctggcaggaagcacgctacggtaaactgtgggagcagggcgtcgaaggcatcgaaaagtacaacgacatcaacaaagtcgagccgatgaaccgtgcgctgaaagagctgaatgcgcagacatggtttgccggcctgcgccgtgaccagtccggcagtcgtgccagcctgccggtgctggccatccagcgcggcgtttttaaagtgctgccgattatcgactgggataaccgcaccgtcttccagtacctgcaaaagcatggcctgaaataccatccgctgtgggatcagggctacctgtcggttggggatacccacaccacccgtaaatgggaaccgggtatggctgaagaagaaacccgcttcttcgggctgaagcgtgaatgcggattgcatgaaggttaatcaataaatatccctccgcccggcagtgcaattctgccgggtgtcacttcttatatactgacgttgtgattatatggttggtatctgttcattcttttttgtaaagcaatacttgctagcttcatcttaccaggttcgcatcagctgtattacatcaagattcactgcccaaatattctttggaaatttacaggtgatgatttacagaagtgcattacaatcccaaaatggaccaagaaatgcgggttggttcgaggaaaatcaacgtgacactattgtttgatttttagacgaacattcgtgaacgagccattcaacgagagaacatctcctgaataggttatgtcgatgtcaccattttgatcgaccctggcctcgctgacgctaccgcgaccctcaatgacaggtcttcccatgctaagctggcgaacaacctcttcatcactgccgctgagatggtctgccagatagtaacggtaaactgtcggaacggttgccccgccatcgcggctaacagtcatatacagccattgatgatcggacaactgataagcgcgcttaagctcgtcgttcaccctgacgttcggctgatgattgagccaccagaaccccacgatcagtacgaaaagaaccagtgtcacgactctatgcagccatttaatagccgttctgaatggcatattcgatcccttcctgaatatagcgctgatcggttgggtcatcgccataaggaggcttttcgtgccactgcccccactctggtttagacgtacctgcgcgactctgggcccatcccgctcccataaggagtattcgcgcaggaattccggcagctgtgccagctgcgccaaaattgaaattaccgaatgcctgaaaatatgggtcaaactgtttatagtcccatggcccaccacggcgaactttctcataaaaccaatagtaggttgacgccgtcgccatgttgcgcgacatccctttttgacgagcctcgcgcatattattagcgataacgatagaacctggaccgggaattgggacggatgccataaaatctccttattttttcgcttcaaagctccctgaataaatgaaatacctccaatttaataccgaggatacatattcaccaacaaaaaaaacattacactttgtattgttattgggcaagtttttgccgcgctttattgtgattttcatcacggaggtattcgccccttttaggctcgaatacatctgccctctcgcttaacggcgcagaattgtttatctatattttttggtttgctgaggaacgtttctactttcccctttaagtcatacttctacgccagtccagcagcaccgtaatgttatccattacgttatctttggcttaaaaagtctcccgcagagtagttaagtaacgtcagagaatgcgtgtatatgtatcctctgcgacatgctaaaagtgagcatgatgtatttgcttagctgccagccctcaccgattctggaagttgaatttatgttacccttatgagtaagaatgcctttatcaggcattcccgattcacactttttaaaaccatcaagcaatttacgttttcgcccgtgccagttccttcaccagcggcagcatgatgcgcattacgtcgcggctgcggcgttcgatgcggcctggcagggcgctgtcgatgtgctgctggttatccagacgcacatcgtgccaactggtgccgtccgggaatgaacgggttttggcgcgctgctggttaccgtctttattgcccagcgaccagtttgtcgcttccaccgacagcaccggaatttttgctttatcaaacacctcaacatcgtggcagcacgacgtgcctttcgggtattgcggattcaggccaggattggtggcggcggcgatgccgcgactgcgggcaatggccagcgcgcggtcgcgggtcagcttgcgtaccgaggcgggggtatttttgccgctgttgaaatagagcttatcgccgacgatcagattatcgagattaatcaccagcagggtatttttccgctctgcctcgctcatgcgcttcagaaagttttccgcgccgagctggccttcctcctcgccgctggtggcgacaaaacggatactgtactgcgtcggaacatctttcagcgcgtcggccagctccagcatcacgccaacgccggcagcgttatcgtccagcccctgtaaggtcaggccgccgagattgttatcaatatccgcatcgctgcgcggcgcgtaggtgtcgaggtgcgccatgataataatctgctcaggctgcttgccctcatgcgcggcgatcaccgtgctgccggtaatgttgtgccagttacgctgattggttttcgaggtatagataaagcggctggtgaacttgcggatatcgctctggtaacccatttgcgcaaactgctgtcgcacataatccgccgaaagcatctctgccggcgtgccggtcatacggccggggaaataggttgcaatataacgtgcctggtggcttgccatgtcaccgggaggcagcaacgccgcctgaacgggaagagtaaagcatacgccgaacgccagggcagcggtacggtggcgcaatgcggaaaacatagtgagtccttaaacatgccggaaatttttgaccggcttagtatgaaactgtgatcggccttacacaatttgaattgcgcctaaacgcacgaattttctggcgttaagcactttttgatatttgctttcccgcgccgttattcctttgcggaactactcattccaattcgtaatttcattcgctcacagccgccccctatagtccccttattcctgaatgttagcgagctgttaccttgtggatcacctgcccatttttgctgcggtaaaaaaccgacccgtgctggttattggcggtggcgaaatcgccgcccgtaaaattgcgttcttattacgcgcgggggcgaaggtgcaggtcgtcgcccgtgaactgggcgcagaggtgcagcgtctggtggatgaacaggcgctggtgtggctggcaaccgagttcgatgaaacgcagcttgatgctgtgtttctggtcattgccgccaccagcgaccgcgcgcttaatcgtcgcgtctatgacgccgccgacgcccgccagcggctggtgaacgtggtggacgaccagccgctgtgctcctttattttcccgtcaatcgtcgaccgcagcccgctggtggtggcgatctcctccggcggtaacgccccggtgctggcgcgtctgctgcgggaaaaaatcgaagcgctgcttccggcaaatttaggccgcatggcggaggttgccgggcagtggcgcgagcgcatcaaaacctttcgtaaaaccacagacgcgcgtcgtcgtttctgggaagcggcctttcgcgggcgcttcgccagcctgatggctgccggaaacgaacaggccgccgaagcggtgctggcggaagagctggcatcgccaggcagtgctggcggggaaattatcctggtgggcgcagggccaggcgatgccgggctgctgacgctgcgcggtctgcaggttattcagcaggctgacgtggtgttttatgaccatctggtcagcgatgaggtgctggagctgacgcggcgcgatgccgacaaaatctgcgtcggcaaacgggctggcggccatgcggtgccgcagcatgaaaccaatcaaatgctgattgatgaagcgcgggcgggcaaaaccgtggtgcggctgaaaggcggcgatccctttatttttgggcgcggcggcgaagagcttcaggctgctgccgctgcgggcgtgcctttccaggtggtgcctggcgtcactgccgcttccggcgcaacggcttacgcaggcattccgctcacgcaccgtgattttgcccagagcgtgacctttgtgaccgggcattacaaagccgacagcacgcctttcgactggtcgcagctggcgcagagccgtcagacgctggcggtgtatatgggcaccatgaaggcggcggaaatcagccagcaacttatttcgcacggtcgcgataaagcgacgccggtggcagtgatctcgcgcggtacgcgccgcgatcagtcagtcaaaaccggcacattagaacaattagagaacctggcgcttaacgccccgatgccagcgctgctggtggtgggcgaagtggtgcacttacgcgatgcgctcgcctggtttcaacactctacaggcacgggatcttttgataactccgtggtaaatctggcttaaggaacggttatggatcaaaaacgactcactcacctgcgacaactggaggcggaaagcatccatatcattcgcgaggtggcggcagaatttggcaatccggtgatgatgtattccatcggcaaagactccagcgtgatgctgcatctggcgcgcaaagcgttttatccgggcacgctgccgttcccgttgttgcatgtggatactggctggaaattccgcgagatgtatgagttccgtgatcgcaccgccaaagcttacggctgcgagctactggtgcataaaaaccccgaaggcgtggcgatgggcattaatcccttcgtgcacggcagcggcaagcacaccgacatcatgaaaaccgaagggctgaagcaggcgctgaacaaatacggttttgatgcggccttcggcggcgcgcgccgtgacgaagagaaatcacgcgccaaagagcgtatttactcgttccgcgatcgtttccaccgctgggatccgaaaaaccagcgcccggagctgtggcataactacaacggccagatcaacaaaggcgaaagcattcgcgtattcccactctccaactggaccgagctggatatctggcagtacatcttcctcgaaaatattgaaatcgtaccgctgtacctggccgctgagcgaccggtgctggagcgtgacggtatgctgatgatgatcgatgacgatcgcatcgacctgcaaccgggcgaaaaaattgagcagcgcatggtgcgtttccgtaccctcggctgctggccgctgaccggcgcggtggaatccgaagcgcaaacgctgccggagatcatcgaagagatgctggtgtccaccaccagcgaacgacagggacgcgtcattgaccgcgaccaggccggctctatggagctgaagaaacgccagggttatttctaaggagccgccatgaatacgactattgcacaacaaattgccagcgaaggtggcgtggaagcctatctgcatgcgcagcagtacaaaagcctgctgcgttttctgacctgcggcagtgtcgatgacggtaaaagtacgctgattgggcgtctgctgcacgatacccgccagatttatgaagatcagctctcgtcgctgcataacgacagcaagcgtcacggcacccagggcgaaaaactggatctggcgctgctggtggatggtttacaggccgagcgcgagcagggcatcaccatcgacgtggcctaccgctatttctccaccgaaaagcgtaaatttattatcgccgatacgccgggtcacgagcagtacacccgcaatatggcgaccggcgcgtccacctgcgacctggcgatcctgctgatggatgcgcgtaaaggcgtgctggatcagacccgccgccacagctttatctccacgctgctggggatccgtcatctggtggtagcggtgaataaaatggatctggtggaattcagcgaagagaaattcaatcagatccgcgaagagtatctgaccttcgccgaacagctgccgggcagcctcgacatccgctttgtgccgctgtcggcgctggaaggcgataacgtggcgagtcagagcagtaatatgccgtggtacagcggcccgacgctgctggaggtgctggaaaccgttgagatccagcgcgtggtggagacgcagccgatgcgttttccggtgcagtatgtgaaccgccccaatctcgatttccgcggcttctccggcaccattgcctccggcagcgtcaacgttggtcagcgcgttaaagtgctgccgtcgggcgttgaatcgacggtggcgcgtatcgtcacctttgatggcgatctgcaacaggccggggcaggggaagcggtcacgctggtgctgaaggacgaaatcgacatcagccgcggcgatttactgctggatgcgcaggacgggctgaaagcggtgcagagcgcgtcggtagacgtggtatggatggcggagcagccgctgacgccgggccagagctacgacatcaaagtcgccggtaagaaaacccgtgcgcgcgtcgatggcattcagtatcaggtgaacatcaacaccctcgaacataatcaggctgaaaacctgccgctgaacggcatcgggctggtggatctgacctttgacgaaccgctggtgctggataagtaccaggaaaacccggtgaccggcggcatgatcctgatcgatcgtctgagcaatgtcaccgtgggcgcaggtatggtgcgggagccgaacgagcaggcaaaccatgcgccgtcggaattcagcgcctttgaactggaattaaacgcgctggtgcgtaaacacttcccgcactggggcgcgcgtgatttgctgggaggcaaataatggcgcagcacgatgaaaacgtcgtctggcatccgcatccggtgaccgccgggcaacgagaacaactccacggtcatcgtggggttgtgctgtggtttaccgggctgtctggctcggggaaatccaccgttgccggggcgctggaagaggcgctgcacgggcttggcgtcagtacctatctgcttgatggcgataacgtgcgccacgggctgtgcagcgatctgggcttcagtgatgatgaccgcaaagagaacatccgtcgcgtcggggaagtggcgcgtctgatggtggatgccgggctggtggtattgacggcgtttatctctccgcaccgtgcggagcgtgaaatggtgcgcgaacgcgtcggggaagggcgctttattgaggtgttcgtcgacacgccgctggccatctgcgaagcgcgcgatcccaaagggctgtacaaaaaagcccgtgccggggaactgcgtcactttaccggtatcgattcggtctacgaagcgcctgaaacgccggatgtgcatctcgatggcgaacaattggtaacaaatttagtgggtcaattattagacctgctgagacagaacgatattatcagatcctgagacatgtccggttttgctatcacggacagtcaggtcacaggatccaatatgcgcaatagccagaacatttatctgtcacggtctgagaccgctgcccgcgaggaaaccacctggtcatttccgggggcgatcgttggctttgtgtcgtggttgttggcgctcggcataccctttctgctctatggcccgaatacactgttcttttttctgtatacctggcccttctttctggcgctgatgcccgtcgccgtggtggtgggcatcgccatgcactcattgctggacggcagactgctttacagcagcgtggcgacggtaattatcgtggtcaccatgttcggcgcgttatttatgtggctgatgggctaagccgttccatacttcaaagcgtaacgctcgttaaggcaatgtgtcagaaatgcgcacctgtgcgcccgcccgtaaatagtgctacatttggccgcgatgacgcggtatcggcttagtgtggagtctgcgcgcaagttatgggatgatgatgccgattttcagggggcacgatgggtaaattaacgctgctgttgctggcactgctggtctggctacagtattcactgtggttcggcaaaaacggcctgcatgacttcagccgtgtcaacgacgatgtggccgcgcagcagataacaaacgccaaacttaaagcgcgcaacgatcaacttttcgccgaaattgacgatctcaatggcggccaggaagcgattgaagagcgcgcacgtaacgaactcagtatgaccagaccaggcgaaaccttttaccgtctggtaccggatgcgtctaaacgcacgccagggtcactgcaaaataatcgataagcgaagcccgggtttacgacatggcagcaataattccggacgtttgtgccgtggtgccggccgccggatttggccgccgcatgcaaacggaatgtcctaagcagtatctctcagttggcaataaaacgatcctcgaacacgcggtggcggcgctgctggcgcatccgcgcgtggcaagggtgatcatcgccatcagccccggcgacgcgcgctttgcgcagctgccgctggcggatcatccgcaggtcaccgtcgttgacggcggggccgagcgggcagactccgtgctggcggggcttcaggccgcaggggatgcgccgtgggtgctggtgcacgacgccgcgcgcccctgtctgcatcaggacgatctcgcccgcctgctggcgctcagcgacaccagccgcgtcggcggtattcttgccgctccggtgcgcgacaccatgaagcgcggcgagcctggcatcgccgccgtggcgcataccgtggatcgtaacgatctctggcatgcgctgacgccgcaattcttcccgcgtgaactcctccatgactgcctgcaacgcgccttaaatgacggcgcgaccatcaccgacgaagcctcggcgctggagcattgcggctatcacccggtgctggtcagcggccgcgcggataacattaaagtcacgcgaccggaagatctggcgctggcagaattttacctcacccgaatgaccggaaaggagatggcataatgcgtattggacacggttttgacgtacacgcctttggcggcgaaggcccgattattattggcggcgtgcgcattcctttcgaaaaaggtctgctggcccactccgatggcgacgtggcgctgcatgcgctgacggatgcgctgctgggcgcggcggcgcttggcgacattggcaagctgttcccggataccgatccggcgtttaaaggcgccgacagccgcgagctgctgcgcgaagcctggcgtcgtattcaggcgaaaggctttacgctcggcaacgtcgacgtgaccattatcgcccaggcgccaaaaatgctgccgcatatcccgcagatgcgcgtgtttatcgccgaagatcttggctgtcatatggatgatgtgaacgttaaagccaccaccacggaaaagcttggctttaccggccgtggcgaaggtatcgcctgtgaagcggtggcgctgttagtcagggcggcaaaatgattgcgttcgacgacctgacgtttctgcatggcaaaccccaggcctccggcgcgctgaaagtcagcccggaagattttgtggtggtggaagatttaggttttgaacctgacggtgaaggcgagcacattctggtgcgcattcagaaaaccggctgtaatacccgtgcggtggccgacgatctggcgaaattcctgaaaattcccgcccgcgaagtgagcttcgccgggcaaaaagataagcacgcggtcaccgaacagtggctgtgcgcccgcgtgccgggcaacggtatgccggacatttccgccttccagccggaaggatgcagggtgctggaatatgcccgccacaagcgtaagctgcgcttaggcgcgctgcgcggcaaccagttcaggctggtgctgcgcgacatcagcgatcgcgcggaggtggagacgcgcctgcaaactatcgcgcagcagggcgtgccgaactatttcggcgcgcagcgctttggtctgggcggcagcaacctgcacggcgcgctgcgctgggcgcaaagcaatgcgccggtgcgcgatcgcaataaacgcagttttatgttgtcggcggcccgcagcgcgttgtttaatcagattgtcagcgagcggctgaaaaaaacagactttaatcaagttgttgacggcgatgcgctacaattagccgggcgcggaagctggtttgtcgccacccctgaagaacgcgcagatttacaggcccgcgtgaatcaacgcgagctgatgattacggctgccctgccggggagcggtgactggggaacgcagcgtgaagcgctggcgtttgagcaggcggcgattgccgatgcccccgaattacaatccttgctgttgcgtgaaaaggttgaggcggcgcggcgcgccatgctgctcaacgtgcagcagttaagctggaactggtgggatgacgtgaccgtcgagttacgtttctggctaccggcaggtagttttgccaccagtgtggtaagggaacttatcaacacatcgggtgattatgcgaatattgctgagtaacgatgacgggatccatgcgccaggcattcaggcgctggcgaaggccttgcgcgaatttgccgacgtacaggtcgtcgcgcccgatcgtaaccgcagtggcgcgtccaattcgctgaccctcgaatcttcattacgcaccttcacccatgaaaatggcgacatcgccgtgcagatgggtacgcctaccgactgcgtctatctgggggtcaatgccctcatgcgcccccgtccggatgttgtcgtctccggtattaacgccggggctaacctgggcgacgatgtgatttactccggtaccgtcgcggcggctatggaagggcgacatctcggctttccggcgctggcggtgtcgcttaatggttataagcattacgacacggccgcggcggtgacctgttcgatcctgcgggcattaaaccgggagccgctgcgcaccggacgtattctgaatatcaatgtcccggacctgccgcttgctgaaatcaaaggcattcgcgtcacgcgctgcggcacccgtcatccggcggataaagtgatcccgcaggaagatccgcgcggcaatatgctctactggatcggcccgccaggggagaaacacgacgccgggccggacaccgattttgccgctgtcgatgaaggctatgtgtcggtcacgccgctgcatgtcgatctcaccgcctacagcgcgcaggacgtggtgagcggatggctggagcgcgccggggtgaatacgcaatggtaacaaaacgcatacaggcgctgctggaacagttacgccagcaggggatccgtagcgagccggtgcttgacgcgctggcgcaggtgccgcgtgaaaaattcattgatgaggcgtttgaacacaaagcctgggaaaacgtcgccctgcctatcggccaggggcagaccatttcgcagccttatatggtggcgcgcatgaccgagctgctggaactgacgccggagtcgagggtgctggaaattggcacaggttcaggctatcagacggcgatcctcgcccatctggtgcaccatgtttgttccgtcgaacgtattaaaggcctgcaatggcaggcccgtcgtcgtcttaaacagctggatctacataatgtttccacccgtcacggcgatggctgggaagggtggcaggcacgtgcgcccttcgacgccattattgtgacggctgcaccgccggaaatccctgtggcgctgatgtcgcagctggatgagggcggcattctcgttttacctgtgggggacgaacaccagcaacttaaacgggttcgtcgacggggaagcgaatttatcatcgataccgtggaagccgtacgctttgttccacttgtgaaaggggaactggcctgattcctggaattgtctgagggatttcagcgcatatccgcgtagggtgtagctcatttgctaatgaccgccacggtcatcattaagtcactgacagttaacacattcctggaggataaatgagcacgggaagcccaaaatttaccgtaagtcgcctcgcggcattatcactggtttcgctctggcttgcaggatgctcaagctcggataacgcgccagcgccggtcagctccgtcggcggcaacagcgcttccagttcaggttccggaatgttaattacgccgccgcccaaaatgggcgcgtctgcgcaacaaacgccgcaaattcaacccgtccagacgcctgctattcagccgatgcctgcgcaatcccagacccagccaatggcagaacagccggttcagaccgaaaacggtcgtattgtgtacaaccgtaagtatgggaacattccgaaaggtagctataccggcggcagcacttatacggtcaaaaaaggtgacacgctgttttatatcgcctggatcaccgggaacgatttcagggatctggcccagcgaaacaacgttgccgccccgtatggcctgaatgtcgggcaggttctgcaggttggtaatgcatcgggtacgccgataacgggcggaaatgctatcactcaggctgatgcttctgcgcagggaatcgtcactccgcctgcacaaaattcaaccgtggtggttgcgccgaaaccgacaattacgtattctgaggactcaggtgaacaaagtgataacaagatgttgccaaacaacaagcctgcgactaccgtcacagcgcctgtaaccgtgccatctgctaccactaccgaaccgaccgccagcagtgcatctaccagcgcccctatatcgacctggcgctggccgactgaaggcaaagttatcgacaacttctctgccaccgagggtggtaataaaggggttgatatcgctggcagtaaagggcaggctattatcgcgaccgctgacggacgcgtggtatatgccggcaacgcactgcgcggttacggtaatttaatcatcattaaacataacgatgattacctgagtgcctacgcccataacgatacaatgctggtccgggaacaacaagaaatcagggcggggcagaagatagctaccatgggtagcaccggaaccagttcaacacgtttacattttgaaattcgttacaaggggaaatccgtcaacccgctgcgttatttgccgcagcgataatttggcagagtcattggctcactcttgtttcgtccctgcagcgcgcttaatcgccgttgcagggtaaaaaaacaaacagtgaagttaatgctttgtccagggatcacgggtaggagccaccttatgagtcagaatacgctgaaagttcatgatttaaatgaagacgcggaatttgatgagaacggagttgaggttttcgacgagaaagccttaaatgaagaggaacccagtgataacgacctggcagaagaggaactgttatcgcagggcgccacgcaacgtgtgctggacgcgactcagttataccttggagaaattggttactctccgctgttaactgctgaagaagaagtttatttcgcacgacgcgcactgcgtggggatatttcctcccgccgtcggatgattgaaagtaacctgcgtctggtggtgaaaatcgcccgtcgctacagcaatcgtggactggcgctgctggatctgattgaagagggtaacctcggcctgatccgcgcggtagagaaatttgaccctgaacgtgggttccgtttctccacttatgccacctggtggatccgtcagaccatcgaacgggcgatcatgaatcaaacccgtacgattcgactgccaatccacattgttaaagagttaaatgtctatctgcgtaccgctcgcgagttgtcccataagctggaccacgaaccgagtgcagaagaaattgcagaacagctcgataaacctgttgatgatgtcagccgtatgctgcgtctcaacgagcgcattacctcggtagacaccccgctgggtggcgattccgaaaaagcgctgctggacatcctggccgatgaaaaagaaaacggtccggaagacaccacgcaggacgatgacatgaaacaaagcatcgtcaaatggctgttcgaactgaacgccaaacagcgtgaagtgctggcgcgtcgtttcggtctgctgggttatgaagccgccacgctggaagatgttggccgtgaaattggactgacgcgtgaacgtgtccgccagattcaggtagaaggtctgcgtcgtctgcgtgaaatcctgcaagcgcaggggctgaacatcgaagcactgttccgcgaataatcgattctgtacaaaaaaggccagtcacatgactggcctttttctttgcccgctcctgagcaagcgggcggagcacacgccttagttcagcgtataatccagtgtgatttcagcgttgaacagctgagataccgggcatccggctttcgctttctggatgatcggatcaaactgatctttctcgatccccggcagtttcaccgtgctgttaagcgcaattttggtgattttaaagccgccatccacctgatccagcgacacatccgccgtggtgtcgatgctttccggcgtaaagcccgcttcgcccagcattagcgacagcgccattgagaaacagcctgcgtgggccgcgccaatcagctcttccgggttagtcccggctgcgccttcaaaacgagtattaaaaccgtaaggctgctgcttcagcgcgccgctttccgtggagatggtacctttaccgcgcttaatatcgccttcccagtgtgcctgccctttcttatgaatggtcatgtatttactccattttgttgctgaatgaagtaacaagtatagaagctcagccagggcttgcccggcaactcggaatactacgaagaggtgcagacacaacagggggaggttgtaggcccggcaagcctgcgccgccgggcggagggcgtcagaccagactcttcagacgatagatccactccagcgcctgacgcggcgtcagcgtatccggatcgagcgcctccagcgcttccaccgccgggctggtttcttccgcaggcatcagcagcgacatctgcgtaccgtccacctgggttgctgccgcgttcggggtaatgctctccagttcgcgcagcttctggcgcgcccgcttgatcacctctttcggcacgcccgccagcgccgctaccgccagaccatagctcttactggccgcgccgtcctgtacgctgtgcataaaggcgatggtgtcgccgtgctccagcgcgtccagatgcacattcgccacgccttccattttttccggtagctgtgtcagctcgaaatagtgcgtagcaaacagggtcagcgctttaatgcggttcgccagattttccgcacaggcccaggcgagggaaagaccgtcataggtcgacgtgccgcggccgatctcatccatcagcaccaggctgttctcggtggcgttatgcagaatattggcggtttcagtcatctccaccataaaggtcgaccgaccggaggccagatcgtccgccgcgcccacgcgggtaaagatacggtcgatgggaccaatctccactttttgcgccgggacgtagctgccgatataggccagcagggcgatcagcgccgtctggcgcatataggtgcttttaccgcccatattcgggccggtgatgatcagcatccggcgctgcggtgacagcgacagcgggttggcgatgaatggctcgttcagcacctgctcgaccaccggatgacgtccctcgacgatgcggatccccggtttatcgctgaaggtcggacagctgtaattgagcgtgtcagcgcgctcggcaaggttcaccagcacgtcgagttctgccagcgcggtggcgctctgttgcagatcccccagatgcggcatcagcagatcgaacagctcttcatacagctgtttttccagcgccagcgctttgccttttgaggtcagcaccttgtcttcatattccttcagttctggaatgatgtagcgttcggcgttctttaacgtctgacggcgtacgtaatgaatgggcgcaagatggctctggccgcggctgatctgaatgaagtagccgtgcacgccgttatagcccaccttcagcgtatccagcccgagtttttcacgctcgcgaatttccagtttatccagataatcggtcgcgccatccgccagtccgcgccactcatccagttcggcgttatagcccggcgcgatcacgccgccatcgcgcaccaggaccggcggcgcgtcaataattgcccgctccagcagttcacgcagttcgctgaactcgcccattttttcacgcagctgctgtaccggcttgcagtcgacgtccgccagctgctcgcgcaggatcggcaactgctggaaggcgtgacgcatacgcgccagatcgcgcgggcgggcagtgcgcagcgccagacgcgccagaatacgctccagatcgccaacctgacgcagcactggctgcaactcagcggtcagctcctgtaacgcgccaatggtctgctgacgttctgtcagcactgcggtatcacgcaccggcatatgcagccagcgcttgagcatacggctgcccatcggcgtgacggtgcagtccagcaccgacgccagcgtattttcaaagccaccggccaggttctgggtgatctccagattgcggcgcgtggcggcatccataatgatgctgtcctgctggcgatccatggtgatggagcggatatgcggcagcgaggtgcgctgggtatctttgacatactgcaacaggcagcccgctgcacagaggccgcgcggcgcgttttccacgccaaaacccaccagatcgcgggtgccgaactgtaaattcagctgctggcgggcggtgtcgatttcaaattcccatagcggacggcggcgcagaccgcggcggccttcaatcagcgaggtctccgcaaagtcttcggcgtagagcagctccgccggattggtgcgctgcagctctgccgccatggtctcccggtctgccggttcactgatgcgaaaacggccggaactgatgtccagcgtggcgtaaccgtagcctttgttgtcctgccagatggcggcgagcagattatcctgacgctcctgcaacagggcttcgtcgctgatggtgcccggcgtgacgatgcgcaccactttgcgctccaccgggcccttgctggtggccggatcgccgatctgttcgcaaatcgccaccgattcgccaaggctgaccagcttcgataaatagttttccaccgcgtgatgaggaatgcccgccatcgggattggctcgcctgccgatgcgccgcgtttggtaagcgaaatatccatcagctgtgacgcgcgtttggcatcgtcataaaacagctcatagaagtcgcccatacggtaaaacagcaaaatatccggatgctgcgccttgagcttcaggtactgctgcatcattggggtgtgggcgtcgaaattctctgatgtactcattggcgtatgatgtccatgttcttaacttttaatgaatgagtgagttttttatttttttacgtctcaccgcaacctgttcggtttataaggcatagcgagcatgataacggagtctgtagggcaggaaaacaacaggggaaggctttacccgtttaagtgcgccagaaggtatgcagacaggctgcggtatgacgttatgggtaatacttgatatactattagtcttacatgtgactgacaggagacgctatgcgaaacaatcaaaaaggtcagcaaggctataccagcccttcacgcgctgacattgcgcgcgctgttgtgacctcaacagcggttgaaaccggtcagccttcagccaaagttgaagcttcgcttgaagcggcgcgtaaaaaattcgcccatcttcgtcttgcctaatcctttcttaacgcctggctcacccagtatttcatcggttcgtaattcatcaccatgcccgcatgaatagctgagatgtaccgggttttgttctgctcccagcgttgatagtccagcggcttatagcccccctgaaccgccatcacatcggctaaaagtcgtgataatcgcccatttccttctctgaaagggtggacgagtatgagttccacatgtgtgattgcgatagcttcaatcagctgctcttcgctcataccagtacagggtgtgtaacgggcaaggtatttcacatcaaaatccttcagcagtttgggcagctgtgctgaaggagcaaacataaagccgcctttactgatattgaccgtcctttcttgccccgcccacgcataaatattgcctaaccagcgtcggtgccagctttttaggatctcaactgtgatcaaccccagcggaaaatgctgttcaaagacagcgtgatagagttgctcgaggagtaccagttctgcgtcatcaatgtcatgagcatcactaatcccgagcttattcgccaaaatttgttcgccagagcctttctcaaactggccttcgctattggttacatggtatcggctcattgcaataccctggtttataaggcacagcgagcatgataacggagtctgtagggcaggaaaacaacaggggaaggctttcgtttaaagggacatcgcgcaggatgaaaagccgctatgctgccagtcggtttcagagcctgcgcgtatcattaaagatgcatcagcggcgttcacgcagcgcggcgatatcctctggcgtcgtgcggcagcatccgccaatcagtttcgccccggcctctaaccactgtgacacatgtcccgccagggatccgcagctgtcgccatgcgtatgccaggccttgcttaccgcgtcataggtttcaccggaattaggataaaccaccagtggcaacgcgctcaggctttgcaggtgcttcagcgcggcggtggttttattcagcgcgatacagttaatccccagcgcaataacttgtggataggcggcaagcgtattcaccacctgagcgagcggtgtgccatcgctcagatgctggtcatcccttaaggtaaaggagaaccacgcccgtgcctgcgggtactctgtcagcaggtcagccagcgctgtgatctcggcaaaagagggtaaggtttcacaggccagcagatcggccccggcattgagcagggcttcaatgcgcgggcgatgaaaggccttaaattcttccgcagggcgtacataatcgccgcgatattcagagccatcggccagataagcgccgtatggcccgacggatcccgccaccagcagcggacccgcggctggattttcacgcagatagatttcccgcgcttctttcgccagcgcaacgctctgttcaatcagcgctgccgattgtgcctccgtcagtccacgtgccgaaaagcccagaggcgtggcctggtaactggcggtaatggcgatttgcgcgcccgcgcggaaatagtccagatgcacgtcccggataagctgcggattttccattaacacttttgcggaccagagattatccgcaaggttgcatccgcgcgcttccagttcggtggccagcgcgccatcaagtacggcaaagggatgactttcaagcagagcggtaaggggattaatctgcggcatagtcagtctccttcgatgtggttttatgagtcagaaaatagctggcatagcagagggcaacgaaaggtatgccgcaccagagcgcaatgcgctgatcgggatcgaacgccaggccgatacaggcgagcagacacagcaggaagccgagcaccggcaccaggggataccagggcgcccggtattgcaacccggcgagcggcttacccgaccggatgtggcggcgacgaaatacaaaatgagaggcgcagatgctgagccagacggctaccacggcaaagccagatatggcgctgagcgcaacaaataccgtatcaggggcgatcacgctggataacagcgccagcaggccgccgatcatagaagcggaaagcgccaccagcggcacgccgtttttattaacgcgggcaaaacagcccggcaaggttttttcattggacagcgaccacagcatgcggcccgatgcatagagaccggaattcgccgcagaaagaatcgccgtcaggatgacaaagttgaaaatatccgccgcatacggaatgccaattttttcaaagaccagcacaaaggggcttttctcaacgcccgcgacttccatggggatcagcgctgcgagaacaaagaccgtaccgataaaaaacacaatcaaccgggcgatagtggcccggatcgccaccgggatcgcctgatgcggattttccgtttcccctgccgctatgcctataagctccgtgccggaaaacgcgaaattcaccgccaccatggtcatcagaatgggcagaccgccgtgggggaaccagccctcgcgggtgagattaaccagcccaggcgcggaggatccatccttcatcgggataaaaccgaagatcgccccgcagcccaggataataaagacgagaatagtcgcgactttaatcagggagaaccagaattccccttcggcaaaaaagcgcgttgagaccgcgttaagggaaaaaatcagcacgcaaaacagggcgctccatatccagacagggacgtgtggaaaccagtactgcatacagaatccggcggcggtgaagctcgatcccagcgccactgtccaggtaagccagtataaccatgccacggtgtagccggttgccgggccaatatagcgcgccgcataaacatggaaagcgcctgtcacgggcatcgccacggaaagctccccgaggcactgcatcaccagccagactaccagcgcgccaatcaggtaagccagcagcgtccctgccgcgcctgtggtggaaatgatgtagcccgtgttaaaaaacagccctgtgccaatgacgccgcccagggaaagcatgatcaaatgccggggtttcatggtgcgcttaagctcgccattttcttgttgcctttgcatatcaccttctaaacgtatggatgtctgaatgtccgtatggcgttctttatagcctgattgttaacaaaagaccagcccggggcatgggggagcgcgcgccagtggtcaccgggtgccggatgcagaaatttttcagggtaaaggttaataattattaaaacgccataaatattggtcgcgtgttttaacaccgttatgaattgattaatctcacaattaaaatttccatgatagatatttattattttaacgaagtttttattagcactttcttgtgcaaattatttcgttgattagcagacgaactaaaattaattacagccaggattaatcttataagtacccttaaacatttatctttctgcccgtttgctaattaggctctattcttataaagcagcgcaatctcttaataaaactctctttaatgctaaagaaaccgagcggttccccggaataatttatcaattttatttttcattcacgtcccgtgtgcgcatgaaaagtatcattgcggagacgttgctatgcaggtgttcagatcgttctggcaggcggggtatgagggtgccgatcatatcacccgaaataatgatgcgctttcaatgaataacgccacagcccatgataaaaagcatcggcaggattatcaggcgctcgcgccatttcaaattaccaccgtcagggaaagcgtcggctggcggctggtggaacaggaaaatggctacgacttttcttccgttgctgaaaaaatggcagcagcgcaggacaacggcattcagatttgctggaccatttgtcattacggctggccggaaaatattgaattcttttccgaagattttatttcgcgcttcgctcagctgtgcggagcgctggctacattcctgcgcccgtattatgacgaggcgccagtttattcgccgatcaatgaaatgtcttttaccagctgggggatatcggtcggactatttgcgccttctctcagcgtgcgcgatccgaccggtattcgcagcaaacgtcaacttgttcgcgccacgcttgccgcctgcgatgccatctggcaggcggatccccgggcgcgatttttacactgcgatcccattattcatctggtatcgccggacgacagccccgaatcgcagcagaacgcggcaggctggcacaacgcgcagtttcaggcctgggatatgctcgccgggcgtctggagccggaactgggcggcgcgccgcgttatctggatctgattggcgcgaattactaccacgacaaccagtgggaaagcgaaaccaaccgccgtctctggtggcatctgggcgacagtcggcgcaaaaggctgcacagcctgctggcagaactttatcagcgttacgagcgccccctcctgctggctgaaaccagccatgtgggcagcgggcggggtgcctggatcacggagattgcccgggaagtcgcccaggcgcagatcgcgggcgtggagatgatggggatctgtctttatcccgtcattgaccggccggactgggaaaaccacgccgtctggcatcgcagcggcttatggaatatcgaccccgaaggacatgacccttttgaacgtcagctcgatccggtctatgcgcaggcgctcaaccgcgcccggcagatgctcgatcatttccagtgtttatttagcgtggcgcacagggcctgcaaagagagaaaacctatgaaaagaatctatgtttttagccatctgcgctgggattttgtatttcagcgcccgcagcatttgatgacccgtctggctgagcactattcgatattttttatcgaagagccggtattttccgccgatgaaccggcgctttacctgagccagcccgcgcctaatgtgaccgtcgtgaagccgcatacgccatcgccggttaccggttttcatgacgggcagatcgagtatatgcagtcgttgctggcggaaattaccgaagacgacgaaacgcccatcgtctggttttataccccgatggcgctgccgctgctgaaagtcttctcgcccgcgctggtggtttacgactgcatggatgagctggccgccttcgaaaaagcgccgcgtcagctgctgcaacgtgaatccgcgctgctctcacgggcggatattgttttcaccggcgggccaagcctgtatgcagcgaaagccgggcggcatcacaacgtgcactgcttcaccagcagcgtcgatgcggtgcattttgaacaggcgctggatcgcgctaaccatcatcctttacaggacgatattccccatccacgtttgggattttgcggcgtgattgatgagcgtatggatctggacattatcagcgcgctggcggacgcgcatcccgactggcaactggtaatggtcgggccggtggtgaaaatcgatccggcttcgctgccgcagcgacaaaatatccattatctcggcatgcagccctatcaggcgctgccgcagttcctggcgggatgggatgtgtgtctgatgccttttgcgctcaatgccgcgacgcagtttatcagccccaccaaagtgctggagtatatggcggcgcagttgccggtggtcagcacgcccattaccgacgtggaaaaaccatatggccacgtggtggcgattgcccgtacgcccgcagagtacgttcgcgcctgtgaagcggcgctgcagatgagtgacgcggcccgccaaaatcagcagcaggcgatgcagggcattgtggcggcgacttcatgggatcacactgccgaaaaaatgcatacgctgatggataatctgctgcacagcacgccgccggaaaatgtgctcagcgccgcaacggacatggcggagatcaacgacccttcggtattacgcctgacgccgccgcaccatgcgccggcagtgtccacccgctgtctgattctgggagccggaccgacagggctgagcgccgcctttcattatggcgaaggcgcgaccctgctggagcgcaatgccaccgttggcggcctgtgccgatccatcgaggacaaaggattcaccttcgattacgccggacacattatgttttccgaagacagctacgtgaaagcgctgtacgacatgctgcttggcagtaaccttcactggcaggcgcgagaggcctgggtctacaccgagggcgtctatacccgctatcctttccagggcgcgctctacggcctgccgcccaatatcatcaaagagtgtattctcggcgcgatagaggcgcgttatggcgtggcatccgcggcgaaaaccgtgtcgatccgtagcgataaagaggcctcctgtgacagcagcgccggtcaggtggtggactgctgcgcggatggcagcatcccggatctgagcagcaatgacagcgtgcaggacgccatgccgccggacaattttgaaagcttcatctataaaacctggggcgcgggcatcgccaggcacttcgccattccgtacaacaaaaaattgtgggcggtgccgctcgccgagatggaaacctcctggctgggcggacgcgtaccgctgccggatctggcacagatcattgaaggcgcgctgaccgaaaagggcaaaccgatggggccgaacgctttcttcggctatccgctgaaaggcggcttccaggcgctgatgacggcatttttaccctatattaaaggtacggtggaaaccggggcggaagtgaagcagatctttgcccagcagcatctggcggtgctggcggacggcagacagtatcgttacgaacagctgatcagcaccatgccgctgccgcagcttatccatattatgggcgatgaagtgccgtcatcggtacgggcggcggcaaatggcctgcgccatgtgtcggtgcgctgcgtcaatctgggaataggccgggcgaatttaaccgataaacactggatctattttgcgggcagaaccgtcttccaccgtatttttgttcagggcaacgccagcccacactgtaatccggaaaatggcttcgggctgacctgcgagatcacctattcaccggacaagccgctgccggagcagggacaggcgctgatcgacagatgcatccgggaatgtattgaagtggggatctttaccgctgacgatcccgtgctgaccgcaagccaggtcgatattccctgcgcgtatgtgctttacgatcatcagcgtaaagcaaatgttgaaacggtcagaaaatggctgttatcccgtgacatcattctgtccggacgctacagcgaatgggaatattacaattccgatcatgcttttattgccggtaaagttgccgcggaaaaagtgaaaaacgacgaatatcgtcattcaggtttatagtctgtgttaacaccgggcaggtatctgcccggtgaatatagtcaatgttattaatctattacccgcctgcatttccccgccttttcagatttcatcaagagatatcaattacctgtttatttaagatgtgtcgctaactgacaggggcgattgttttttaaacatattaccggtcagtcacactatttcatggaatacgcccatcaggaagatgagcgttaaaaggaagacgacaatgaaacgacacccactattatatttattaggcacctcgctgttattgggcgccagccaggtcagcgccgcggataatagcctttttatcaaaagcaaattactgaaatcctccagcgaaacccgcgccatcgccgcggatcctgcaacggcctcggttgaggttatcggcattaacagcaacattattgccgactccacgccttttctgacggtgctgctgccgggccagacgaaggaagaaaaggtctggttagccagcttcagcaaaaccgatcgtgggatgcaggtctggcgcggccgctataaccgcaaaatgctgaaaaataccgccatgaagtcactgaaggcggctgactttgattcggtgatcctggtacgcaaaggcgataaggtcaccggcaccgtgcgtcgcaacggacagctgtaccgcatccagccgctgagcagcggccagcatgcggtgatcaaaatcaacgaagccgccgtaccttacgacacagaacatctggaaacggtgatttctgatgtcacctacgaagaaagcgacgcgcctgatttatcccgcctgggttatacgctgccgtgccagtcatcctggggggccgatactacctatccggaaaaaggctggatggtgagctacaacgagcgtaactaccgcagccgctgggaaaccaaaggcgaaatgccgggcgtatcgccagtatgggagccaaacggcgtatgtattcagattggcgaagccccggcgccactaccattacctgtacccgtgcaggtctgtgcggcggaatgggcggcgcagaacagctatccgcaggcggatctgttggtgagctaccagggcatcaactatcgcagccgtaataaggtggcggcggatgatgtgccgggcgttaacccggtgtgggagccgcagggcacctgctatgtgcccgcagtgccgcagcctgaaaagtccacggtgagcgtgctggttgctgccacaccggcggcggcgaaaagcctgggcgatctggacgcggtggcgcagctggcggtggaagaaacgaacgaaggctatgaaaacagcggtatcgatctgaaactggtgctggcagggaccatgatcgatccgtcctatgtagagcctgcgaattcatccgacatgctgcgcgatctgaaaaacaccaatgacaacaagctggaagaagtgcactaccagcgcggcctgaccaatgccaatattgcggttctgctggcgaagaagtacggtttctgcggccaggcctatgtaaacgccagggcgtcaaccgcctttgcggtggtggaggcttcctgcgcggtgggcggttacagcttcggtcatgaaattggccatttgctgggggcggcgcataacaaatccagcgccaacgcttatgcctacagctatggtttcggctggcaggatccggaattcctgttccgtaccatcatgtcctatggctgcgccaaatcctgcccgcgcatcaactattactctcatgccactatggagtacaacggtaaaccgatgggcaatgcgactgaagcagacaacacccgtgtgctgaaagagcgtaaggaaacggctaccacctggcattaatcctgtcgcgctctgcgatatatcgtatttaatcagaaggcgggcataatggcccgcctcttttttttgtaagattattaaatataaataaatatattcttactctgccgcttcgttatattccatgtctcgctttaagataattccaggcactcctggcacaattaatataatggcttttatatttgcatcttcgctggcagacgctatagttaatattgcctgacggggaaatacttcccctgatttaccaaaactcaatgaggtattaattatgactcagcaacgtggcggttccggtaatttctcacaagatcgcgaacgcgcatccgaagcagggaaaaaaggcggccaacaaagcggcggcaactttaagaatgaccctgaaagagcctcagaagcgggtaaaaaaggcggtaaaaacagccatggcggcggacgttcttcctgatccgtcaatgcgctaaccggtgttctttcatttgctgacgtgaatgatgacgttaaaaattaaagaaccggtactggcaatcctgcacttacgtgtggggttgccattttgtttttcaggaaatgataaataaaaagtgctatcaggattttaattcttccagcagcagaatagtgccggccatggcgtaattcgccgcctgcaataatactgcctcactgtccccttcaaattgtttacactgggtataggtttctgaccctggtaattgccatgcaaaccagatagttcccgcgggcgtgccgtcttcgccaccatcaggcccggcgtaaccgctgaccgcaattgccacgtccgcgccagaatgagcaatagcaccggccgtcatctcaatcactgtctgctgacttacggcagtgtgcatctcaatggttttcttcttaacgccgagagtggtgatttttgcttcatccgtaaaagtgacaaaaccgctgccataaaaagagggggtgtcttttgccgcacacaatgcagaggcaatttgtccgccggtacaggactcagcagtggtcaaaaagagttttttttccgtcagtaagcgacctaattcattggcaatagacgccgaaggcattgtcataacaaactccttaactgcgcgagcccggaataagatccgggctcgctcagaatgcattgaaaaaattaaacgtcttttttcgctgcggtattttcaatcggctctgcaacggatcccaggtcagtgccggtgaccggattgatagctgggtcggactgcgtgcgcttgatcatcgccagcaaatcactttcctgctgcggaggcagcgtcacagaggctttaccgtcgccgccgtcaacagctggctgcggatcggcaacatagttgaagttctcgtcgctgttccagctgccacgaacttcttccccttcagacatattgaagtaggtgttggcatactgctcaattggcggcaatttacccggcgggaaattgttgcgaatagagtacagggctttttcgaaagacatctggtgcgccacttcgcgcgtcatcaaaaagcccagcgcatctttcacgcccggatcgtccgtcaggttaataaggcgttcatagatgattttcgcacgtgcttcagcagcgatgttagaacgcagatccgcggtcggttcgccgatggtatcgatataagctgcggtccagggcacgcccccggagttcgtcagcggcgtaccgccgccgtacagcagagaggtgatatggctgtcgttgccgcggccggtcagcgagcgataaagctctgcttctttttcagtcccttccgctagttcacctttggcacccttgttcagcatgccgaccagcgtaccgatgatttcgaggtggctcagctcttcggtggcgatatccagcagcatatctttgcgtcccggatcgtcgtcactcaggccctgggtaaagtagcggcaggcagcagccagttcgccctgcgggccgccaaactgctcaagtaaaaggttagcgaggcctggattaggctccgctacacgaacggtgtactgtaattgcttcacatgtctgaacataatttcctctgttttatcatcatcgcccgaaggcgtggtctgcgccggttctcagtggaaagattactttttagcttcggtgtccggtgtcgccgaacggatcaggaactgctcggtgacgtctggaatatgggtgatgcaccattccgccatcgctttttcctgctccagaatttgtgcaaatacgcgtgcgccttcttcatcaccggccattttcgccgcagcgatcagggaggtgtaacaggcaatttcgaagtgctcaaacacataaccgctgatggcgccttttaccacttcatcaggcgtcatcatgccgccaacggcctggcccagcgccgccattttgctcatggcatcttttacgattgaggtggaaacaccattgcgttcgatcacctgatcaagcaggacttgttgctgacgggtttcttcaatgtgctgcacaatgcgggctttcagatcggggtaatgctccaggcggtctgccattttggacaacattgactcagcttgtttttccatcgcatgagcatcacgtaaccagtcatgataattttccagatgagtcatattaatttctcctgatagaacattgttgtaggcaatatatgtggcggaaaagttgctatcatcacaatgataattccccccccacatttttgtttaccggacacaatggaaacagcgaaacatcatcattattatgtttcaatgttttcattgttttactttctgatagttaagcgtagcacaggcttcgggttgcgctaatttaatgcaaatttttttgtaaatcagtggctcatgcgcaggtattagtttttgaccggaatcaagaagttcagtctgcataatatattttacattttatttttacgtttattagttcagcttcgttttttgtacataagacaaatcctgaacgtttgctgaaatttttcgggcaagtgtcacttgacagtgtttaatatgagtccagacttaaagagtcttttttgaaaataaaagactggaattaataatattcctgagtttatttgcgcttcgttattgatgcgtatttagtagcctgaacatatgtaataaaggagggcacgatgaaatatatgatgaaccctatggctggtcaaaaagacgatccatctgaagcgccggaatccggcgacaaaactgatgccgatccgaaaaagtaatgccagtccgctgatataaccagtcagcggcagactctggcaacggaaggggaaaaaccaacgcttagcggcgtctgtttttccccttttgcttatctggcgacagacgtcaatggcggcgtattatccagctgacgaatggaaggagtgaagcagacggcgatggtcgccgtcacaatggccacggctgacgccagcagcacattactgctgccatagtgtgccgccagtggccccgcagccagttcgcctgccgggatagccacaaaggagccgagcgcatcataagcgtacacgcgggccagcttatcaggtgggatatgcgtttgcagcgactgcgcccaggacacgccgaataatccgaatcctgcgcctgccataaaaaaggccgccatcaacagcgcgggcgaaggtaacaggctgagcaaggctaccggcagggcgcagaggttgaccagtatgacgccgataaacagatcccggcggggccgccagcgaagcgcgataagcgatcctgagatcaggccgaggctttgcgcggcaataataaatccccagtttgcgcggccgaaggtggcgtcggcgactaccggacccagcaccattacgataccgctgaacgccgcgttgacgatggcgaactgcgcgacaatcgcccaaacccatgaacgggcgatgaactctttccagccgtcgcgcaggtcctgcaaaatatgggacgccgggccgtcagacgcgtgcgcgacggcgcgggtcaacagatacagcggcgcggcggcggcaaagcccagcgcatccaccgccagtccccagccagggccaatggcgctgatcaggatcccgcccagcgaagcgccgataacggtgccgccgtaaattcccagttgaataaaagcgttggcttcgcgcagcgtcggcgagggcaccgtttgcggtaccatcgcggaagaggccggaagcgcaatgcccgccgctgcgccgttgatggcgcccagcaccgtcagcagggtaaaggtcgccgcgccatccagcactgaccatgccaccaggccctgcgacagcgcagcgatgatggatgatgacaccagcaccatactgcgggagtaacgatctgccagtacgccgccaatcagcagaaaggcgacgttaaaaatcgaacgcgccgccacgacgatcccaagctcggtagcgctgccgcccatatccagcaccgcgaacgccagcgcaataggcgcgatgccgttacctaatacggtaaacaagcgggcaaaaaacaaatggcgaaacggcgcataagaaaaggcccgtcgggttcgcggcgcgtggttatctgacgtcatgggatgtccccggtggcgttaacctgcccaatccaggtcgtaaagcgggctatacccatgctgatttcctctcccttgcaggtaatttacccggtgatataccggataaaggggcattacactactccgtgcacgggcggatgatcaactgcccgaattcgaccacaaccgagaccgcggccccggtgggaaagcccgcttcggcgagccagtcgccctgtaaggacaaactcgggtgcaggctgtaacgcctggggattttggttttgcgctcttcatgacgtctgcgcacataccccaccgtgatacggcgcatcgctttagacatttttacctctgaaactactggcttcccggtcatacaccactccttttccacttatcggttgttgaacataccgtcataaattgctgtataaattaacagtaaaataccggaaggcaaggtgaggaattgcgaggcggattccagaaatgcaatgcaaaaacagcaacgcgtttcattcacgtaagaatatattgtgcaataagcttttccttattttcctcatgcgaaagtgttagtggatttgtatatatgtcttatattaataagactatttatgagggacgccgatgaacatacccgcactgcccgccaatgaaactgaacgtcttaaatctctctatatgatggatttgctggacagaaaagatgatgagcgattatcacgcttaacccgtgtggcaaaggcgaccttcaatgtgcctattgcgctgatctctctgctggatcgcgacaggcagtggctgatctcgccgattaatgagaatttacggcagacctcgcgtaatgtttccttctgcgcccatgccattttgttgcaggggattttgatcgtcaaagatgcccataaggatgagcgcttcgcgaagaatccttacgtcacaggcgcgccttttgtgcgcttttatgccgggtgcccggtacatttgcccgacggttccattgccggcaccatctgcattattgactcaaaaccccgtgatttcagttccgatgaaattaatttactgctcgacctgggggcagtagtggaagatgaatttttgatcatcagccaggcgatgactgacaagctgaccgatctgcctaatcgtcgtggtttttatcgccttggcgacaaacgttttaaagagatgaccagcacacagacgccgttcagcttgctttatttcgtggtagacaacttacagtcaattaatgacatctgggggcatgccgagggcgataatgtactgcgcgggtttgcccgcagtcttggcagttgtctgcataaagatgatatttgtgggcgggtggatggtagcgcctttgcggtattgctacagcagaaaaacgatcacgacgccgatgcgtttctgtttaaactgcaaaccaaaatcgatgagttaaatcttaatgcggataacaaatatcacatcaactatgcctatggcctgctgcaaagcgatgcggaaaaatacactgatataattgaaatgctcaatgacagcgatacggtgatgtattccgaacatcgcaagaaaaagcacagataagcgccagacttaacgccagcgcgtgcgctcaatgccgcttttttgaggcttaccgatgggcatttcatctgcccatttggtggcatcgttaatcatttcggcgacaataccccgcgtcagcccgacctttttcgcttccaggctggcttcttcccactggcggttttcatacagctgcgccagattcaccagctgaaaaagcatgcctttgcgttcctgtaacgcaatgcgcacgtcggcggagatcaccacctgttcgatcagttcttcctgaggaacaccgagaatgacatccagcagggaaaacaggccgaccataaaagcatcgtttgaagagtggatgccgagtagccggttggcggcgagttcgcagaaacgggcgcggatcaggcttaaataataaatttcgttagttttggcgctgctgaacgacgtcagacaggcgaccagcacaaaacggcgcagctcggtgacgccaagataaaccacaatgtctttaattgactggctgcggctgccgcgaatgccgcgcgcattgtataaaatattctgcgcataacgcataattttgaacgagagcgcgatatcacgcttgagcaattcctcaatctgcatgagatccggggattctgcgttaacttcctgaataagctttagcgcaatgatctgattctgaataatttttttacttttgaagattaccggcttgctaaaaaaatgtccctgaaacagggtgaagcccatatttttgcaggtgtcgaattcttcgatggtttccactttctccgcgaggaaaatcgtcccgttgagcaacgcacggtggtgcagaatataagcctgaatttcctgtaaggtactttcgcgcacatcaaatttaataatgtggacatagggcagaaaagcattccagttatcgctgagcgaaaaatcatccagcgcaatacgaaagccttttttatgcagttgcttaacggtttccagcagacgcggatccggctgtgcggtttccagaatttcgacaactacccgatctttgggcaaggtttctgccagccctttaatcagcagttcatagggaaagttaacaaataccgcgctggcagcgctctgacggtcggttggtacaccgagaaattgttcttcaataagctgagcagtcgcttgttcaggcgagacattgggaaactggttagtcatgctatctctgaagagcagctcatacccgaaagtattgagattttcatcaaaaattgcctgccttgcgacaaaagaaaacattctccatcctcacccggaaccatcagctggtcgctgaaaaaagccgcaaccaatttaagtttaagacaggagccattttgctgcctgctggcgtgatttgtaaagtttagtcacagtaagttgatggttttttatcgttttaaaacaataaattgacattaataacgtttttaccctacctgggggcgtctgacgcccccaggcgggcgcttaatttatggctgtcgcccggcgatcccgccagcctgcgaccagaaaggcgaggataaataccgcagtgaaaagcacgacaatggttggcgcgggggcgctgtcgagccagaaagagagatagaccccggcaaaagagaccaccacggccagtatcaccgccagccacaaggcatgggcgaaacggcgcgtcagcagcaccgcgaccgcaccgggggcgatgagcagcgaaattgacagaataattcctaccgattttaaggtggcgactatcgtcagggcgatcatgcacagcaggccataatggagcagggcggtgttcagaccgcaggcttttgcctgctgcgcatcaaaggcatgcagtaaaaaatccttccattttaccagcatcaccagcgccactccggcggctatcaggctgctttgcaggatgtcgcttgttgccacgcccagcatatcgccaaataaaatatggtcgagatgcacttccgactggatggagatatagaggatcagtcctgcgccaaacatgccggaaaagacaatgcccatcagcgtatcgcgcttaatgcggctgttatcgtcgagatagccggtagcgatggcgcagaacagtccggcgataaaggcacctatggcgacggggataccgatgatccaggcgatcaccacgccgggaaagacggcgtggctcatggcgtcacccatcagcgcccagcctttcagcaccagaaataccgacagcagggcgcagggcacggcgacaatcaccgaaatcgccagcgcgtttaccataaaatcaaactggaagggttcgaacattatgccgcctcctgatttgccagccgcgcccggcggcggttcgccagcagaccatgtttaggcgcaaacacaaaggccagcaggaacagcagcgtttgcgccaccacgatgatgccgccggttgcgccgtccaggtaatagctgacccaggcaccgagaaagctggtgatactgccaatcgccaccgcaatcgccagcaggcgggggaagcggtcagtgagcagccaggcggtcgcgcccggcgtcaccaccagacagatcaccagaaaggccccgacggtttgcagcgcggcgacggtggacaccgacagcagcgtaaagaacagtagcttcagacgcgccgggttgaggccaatggagcgggcatggttctcatcaaaaaaggtcaccatcaggtctttccatttcagaaacagaatgaccagcgagacgatgccgataatggcgagctgaatgacgtcttccggcgcgatggccagaatattgcccagcacgatggtctgaatatttacggacgtgggattgagcgacaccataaacaggccaatgccgaaaaaggatgaaaaaatcaggccgataatggcatcttctttcaggcgcgagcgctgattaagaaacagcatcgcgcccgccgccagccccccggataagaacgcgccgagggagaagggcagaccgagcatataagcgcccgctacgcccggcacaatggagtgagacagcgcgtcgccgatcaacgaccagcctttaagcatcagatagcaggataaaaacgcgcacacgccgcccaccagcgccgatacccacatggcgttaagcatgtattcgtaaccgaacggctccaggatccagttcacggctgctctccttttgcaggcggacggcgggaaataaaggggcgctcgtcatcggtgatgatgtgctcctcactgccgcttaacaccacgtgacgcagcacgccgctgaacgcctgttcaaggttttctgcggtaaaggtggtttccgtcggcccgctcgccagcaccgtgcctttgaccatcactgtgtaatcacagaactctgtgaccgagcctaaattgtgcgtcgataccagcatagtgcgcccctcgtcgcgcagttcgcgcagcagttcgatgatcttcgcttcggtctgtacatcgacaccggtgaatggctcatccagcaaaatgacctgcccgtcctgggcgatggcgcgggcaagaaacacgcgctttttctgcccgccggatagctcgccgatctgccggtgacgaaattccagcatccccacgcgggcaagggcggcgtccacagcctgatgatccggcgctttcgcccggcgcagcattcccatatgcccgtaacggcccatcatcaccacatcttccaccagtaccggaaacgaccagtccacctcctcggcctgcgggacgtaagacaccagattttcacgcagcgcctgtttaacaggccgctgaaggatggaaatctcaccgcccgccagccgcacaaagcccatcagtgccttgaacagcgtggatttacccgagccgttgatgcccaccagcgcggcaatggaaccccgcggcacgctaaaactggcgtcacgcagcgcggtatggccgttgcgataggtgacggtaacgtgctgaatatggaggcctggcgactgggtttgcgctgaggtattcatttttgcgcctccacgccctgctgaatgcctttcaccagggtttcactggttacgcgcagcagatcgagaaaggtcggcaccgggccgccggcggcgctgagggagtcaacgtagagtacgccgccgtagagcgcgccggtttcccgcgccacctgtttcgccggtttatccgataccgtactttcgctgaacaccaccggaatatgatttttcttgatcgcgtcgatcactttgcgcacttgttgcggtgtgccctgctgatcggcattgatcggccacaggtacagctctttgagatcataatcccgcgccagataggagaacgccccctcgctggtcaccagccagcgtttgtccgcaggcagtgagtccagctgcgcgcgcaccggagccagcgttgcctggatcttcgctttataggctgtcgcgttttgctggtagatttgtgcgttgtccggatcgtatttcaccagcgcatcacgaatgttatccacgtagatcagcgcattttcggcagacatccatgcatgaggattaggtttaccgttataggggccttcgctgatgcccatcggttttacaccatcagataccaccacctccggcacgccggacagatgctgataaaaacgcgcaaaccacagctccaggttcagaccattggcgaggatcaactgcgcgccctgggcgcgtttaatgtcgccgggcgtcggctgatattcgtggatctccgcccccggtttggtgatcgaactgacctctgccgcatcccccgccacgttttgcgccatatctgcgatcacggtgaaagtggtgatgaccctgaatttctcttttgcctgcgcgggcgaaagggcgaacagcgaaaccagggcagcggcgaacacgaatctcagacgtgatgagtacggcatggtatccctcatgatggcgtggttaataatacagcgaatatagcctttgctatgttatatagcacacgctataggtctgagcgaaaattattcgcatttaatagccaggcagacaaaaaatcaccgatctggtggcagggaatgtaaagttgtaaaataaaagcatgtttatattcaggagcgcgttcctatgtccggcaaacgcattgcccgcgaaaaactcaccatccgtaaaatgatcacgctctatcagcggcagtcacccgatgccgttgccgatgcggagcattacgacgcgctgtacgcctatgcggaaaaacggctggataaatgcgtgtttggcgaggaaaagccggcgtgcaaacagtgcccggtgcactgctatcagccggtaaagcgtgaagagatgaaggcgatcatgcgctgggcggggccgcggatgctgtggcggcacccggtgctgacggtgcgccatctgatcgatgataagcgcccggtgccggaactgccggaaaaataccgtcccaaaaaatagcccgacctttattccgccgggccatccgtttagtgcagcgtatctttatcaatccccagccgcttcatccttgagagcagcgtcgtgcgttttaaccccagccgctgcgccgcgccttttggcccggcgaccacgccgttggtttcacgcaggatcctgacgatcaactgatattcatcttcgccctcctgcggcgtttccaccgccgcatcgaagcgttgcggcacgctcatttccgccatcgacaattgcagaacgttgccccgcgtcagcagcacggcgcgctcgacaacgttttccagctcgcgcacattacccggccacggctggttgcttaaaatacgcagcgtttcggcggggatgctgtcgatattgcgccccagccggtgggcgattttgaaggtgaaggctttgaccagcaggggaatatcttccgggcgttcacgcagcggcggaatgcggatcggaaagacgttcaggcgatagtagagatcgctgcgaaattcgcgatcggccaccatctgtttcagatcgcgattggtggcggcgatcaggcgcacatccgtctggatcagtttgttgctgccgaggcgttcaaactcctgctcctgcaatacccgcagcagcttcggctgaagttcgagcggcatatcacccacttcatccaggaagagcgaacttttatccgccagttcaaagcggccgatgcgctgggcgctggccccggtaaaagctccgcgctcatgaccaaagagatcgctttccagcagtccggcaggcatggcggcgcagttcattttcaccatgcggcgcgcgttgcgtccgctgagattatgaatagcgcgggcaatcagttctttcccggtgccggtttcgccaaggatgagcaccgtactgttgcttttcgccaccatttccacctgttgcagcacgctgtacatggcttcgctgcggccgataatctccccgaactcgctgtccacgttgttaagctgctcggtgagcgccaggttttcatccaccagccgttctttcaggcggtgaatttcctgataggcctgcgcattgtcgacggcaatggccacccgttcagcgatctgccgcaacagcgacagggtggacggcgtaaaggtttcgccatcgcactgcgcaagtttaagcacgccgagcagcgtgctgccggacatcagcggcagcaggcacagcgtctggatcttattgccccaggtttcaaacagccgacgctcataaggggccagtttgtcgcgctcgtgcagtttcagcaccagcacatccttgctgttaaatacccgctcggagagcgtacccgcctcgtccacttcactttgctcatgcaccggcgagcggtcattcggataatgggtggagtaaatattgagtttgcctttacgactgctgcgcagcacgatgctgatggcgtcgatgtggaaatagtggtggatctctttcgccacctcgctgaccagatcgtcaatgtccagccgggacaataccgcattggtaatggccaccagaatgcggaagttatcccgctcgcggcacagcagttcgtgatcggatgcgccgtcagggtgctgctgaatatgttccatcaccacgccggtgagctgggcgagggtatgcagacgggcgtactctttctcgctccagggcctgtccgcctgacgaataaactcgcagccgccgaagatccgcccgtcaatcgccagaggcagcagagagtagtgtccccagggatcgtacaggccgctggccgccagctgcggccaggtgtcgcagaactccgcgtaattgcagtgcagcgcctccgggcgtgacagaatgcgccgcaccgggccgtgcgccagcagcgtgtcatcttcatatttcaccgcgcggccatctgcccgcgtggcgtaatagcgggcatgatgatcgtcggcgttccataatacgatcgctgcgctgtccgccaggtctgacgccttcaccagctgcgtcaggctctgacagagcgacggcagatcgggctgatgtaataacgtgcgcgtaatatcaaacaggccctgctgcccgagatcgctcatcggtgtatacgacatatcgctagtccagaaaggcaccgaaagccggtgcaaaaagagttttaatgaatacaggtggcggcggcgcaaatatcagcaaatgcgcggcagcggctcagcgtgcggcagatccagtatgcgcttcacgccatataatccggcgagacgcacgcccttgcgcccgaccacttcgcctatcagcgccgcgtcgcggccgagcggatgggcgcgcagtcgctccagtaccgcatcggcggcatggcgttccacggcgatcaccagtttgccttcattggcaaaattcagcgcctccagccccagcagttcacagacgccgcgcaccgccggtttcatcggcaggtcggcctcgcgcagttcaataccgtagccgcagctggcggcaaactcatgggccaccgcgttgacgccgccgcgggtggcatcgcgcagggctttgacgccgggaatatcgcgcagagactggacaagcggcgtcagtacggcgcagtcgctcaccagatcgccatccagaccgaggttttcccgcagattgaggatggtcgcgccgtgatcccccagcgtgccgctcaccagcagcagatcgccgggttgcagctgttgcgccccccagcggatcccggcggggatagcgccgatcccggcagtgttaataaaaagcttatccgccgcgccgcgctgcacgactttagtatcgccggtgacaatcgcgataccggccgctttcgctgtcgccgccatgctgttgaccactgcccgcagcgtgtcgaggggcagtccttcttcaaggataaacccacaggagaaaaagcgcggcagcgcgccgcttaccgccacatcgttagcggtgccgcagatggcgagcttgccgatgtcgccgccggggaaaaacagcggatcgataacgtagctgtcggtggaaaaggccagccggtcgcccgcggcgctcagcgtggcgagatcaaggcgcgcctgatcttcctgctccgccagccagggattgtcaaaggcctgcataaacaggctgccgatcaactgctgcatcgcctggccgccgctgccgtgggccagttgtacggtactcatgcttcactctcctgactgcgatactgataccaggcggcgcaggctccctctgaggagaccatcagcgcgccaaaggccgactgcggatcgcaggttttgccgaacagcgggcactggtgcggtttgcatttaccggtcagcacgtcgccgcagcgggcgcgcggatcgtcatacgcctgctgcggggcagggcgaaaatgcgcctgcgcatcaaatgactggtacgccggtgtcagctgcacgccggagtgttcgatcatgccaagcccgcgccactcgcttttgccttcgacgcagaacacctcggccatcgcctgacgggccagcgcgttgccgccatcgggcaccacgcggcggtactgattttcaaccagactgcgggctgctattttctgctcaaccagcatcagtacgccttgcagtagatcaagaggttcgaaacccgccaccactaacgggcgctgaaagtcgctggcgataaagccgtaggcgtcgataccgatcaccatgctgacgtgccccggcgctaaaaaggcgtcgatgccgttgtccggcgcttccagcaggctgcgcagcgtcgggatcagcgtgatgtgctggcagaaaaaatagaaattatcgagcccgcgcgccttcgcctgttgcagcgtaatggcggtggcgggcatggtggtctcaaagccgaggccgaaaaacaccactttgcgctgcgggttttccgccgccagcgtcagcgcgtccatcggcgaatagacaatgcggatatccgcgccgcgcgctttcgcctgcaacagcgaaccgttttttcccggcacgcggatggcatcgccgaaggtgcagaaaatcacctccggacggctggcgatctccacgcaggtgtcgatgcgtcccatcggcaacacgcagaccgggcagcccggcccgtgaatgaattcgatattgtccggcagcagctgatcgaggccgaatttaaaaatcgcgtgggtatggccgccgcacacttccataatgcgcagcgggcgggaagcggtgtaagagagctggcgggcgcgatcccgcaggcgatcgataagctgcatcacctgttccggggcgcggtattcatcaacaaaacgcatcaccggcctccgctgttgtgggcgtcaccgtacagcagaccgccgacgtccggctctacctcaaacatattttgcagggctctcagggtgtcgcgggcttccgcttcgttgatcacgctcatcgcaaagccgacgtgcaccagcacccactggccgaggcgcgactggcctgtttcatcggtgctgcccaccagcgtcagatccacatcacgctgaatgccgcagacgtccactttcgcctgtaaaccgtcgatggcgctgatctgccccggtacgcctatgcacattgttgcgcctccagccaggcaagccagctgtccatgccttcgccgctggtggcggagatcaggatcacttctatctgtggattcaccgcccgcgccgcctctaaacagcgttcgacgtcaaaattcagatagggcagcaggtcgattttattgagcagcatcagcgaggcggcggcaaacatatgcggatatttcagcggcttgtcttcgccttcggtgacggacagtaccgccactttatgccgctcgcccaggtcaaagctcgccggacacaccaggttgccgacgttttcgatgaacaaaataccgccgtcgtccagcggtaaacgcggcgcggcgtcggcgatcatctgtgcatccagatggcagcctttaccggtattcacctgaatggccggggtgccggtggcgcgaatacgcgcggcgtcgtttaccgtttgctgatcgccttcaatcaccgcgcaggcggttttgcctttcaggcgcagcagggtatcggtgagcagagtggtcttaccggagccggggctggaaaccaggttcagcaccagcagctggcgggcggcgaagcgcgcgcggttgcgggcggcaagctgattgtttttatccagcacgtcgatttccacttccagcatccggcgctggctcatgccgggcgcatgggtgcccgcctcgccatgaccataatgcagatcgccgctgtcggtttgcgttggactaaaggcggttttcatgccagtgatggtaagcccgggccgggcggcaggcgcgaagggcgccccgcgaaacgccgagtgcggattgtgctcgtcgccttctatatagagattgccttcaccgcaaccacaggtggtacacatatttcactcctgttcaatttccagacgctgaatttgcagaccgtcgtcggcgacaatctgtaagccgtcgctgtgacacagcggacaacggcgcacgcgctggctcagtaaggtgacgtactgctgacaatgcccgcaccagcactcggcctgttgctcatcgagatgcagtgtacaaccttccgccagggtgccacggcataccagatcaaagcagaagctcaatgcgctgctttcgacgcaggaaaatgcgccaatttttaaccacacgccggtgacgcgccgcgcgccgtgcgccgctgcctgctgttcgataagttccagcgcgcgctggcaaagggtaatttcgtgcatagcgcctcccgttagtcgatggcctaacgaatgcaataacgatgccagctctttttgacatgtcactgacgatgtcgacgctgacgaaatgacatgtcattttcgcgatggttttgttttttatctttaaaattcaatgtattaaaaactggcataaaaactgctaacaacggttatcgcaactaattgggtaacctgacatgaccatctgggaaattagcgaaaaagcggactacattgccgaacggcatcaacgcctccaggatgaatggcgtcattactgcaactcactggttcaggggataaccctgtcaaaagcgcggctgcatcatgccatgagctgcgcgccggaccgggatctgtgctttgtcttattcgagcactttccggtttacgtcaccctcgccgacggctttaacagccacaccatcgagtattacgtcggcagcaaaaacagcgacgacaaactgttgattgcgcaggcgcaactggggctggatggccgggttgacggccacgtcagcaaccgctcccgcgaagccgtactcgaacactatctcgataaaatcgccaccgtttaccacggcctgtatgccgccattgaacaggatctgcccatcgatctgcatcagctggtgaaccgcccgttacaaagggcgcaggcgtaaccgcacgggtgtcgatgagtgtcgaaacagacagtacatcggcatgatttcgtcaaaaatgaccacctgaggaatgcctggtgaatcgttttgtaattgctgactccaccctctgcattggctgccacacctgtgaagccgcctgtgccgagacgcatcgccagcgcggtttgcagtctatgccgcgcctgaaagtgatgcgcaacgaaaaagaatctgcgccgcagctatgtcatcactgcgaagacgcgccctgcgccggggtctgcccggtgaatgccattaaccgcgtcgatggcgcggtgcagctcaatgaaagcctgtgcgtcagctgtaagctgtgcgccatcgcctgtccatttggcgcgatagaaatgtccggcagccgcccgctgcatattccggccaacgccaatacgccgaaagcgcccgccgcgccgcctgcgccagcccgtgtcagcacgctgctggactgggtaccaggtatccgcgccgtggcggtgaaatgcgatctgtgcagcttcgatgacgccggtcccgcctgcgtgcgcacctgcccgacgcaggcgctgcatctggtcgataaccatgacatcgcccgcgccagcaaacgcaagcgcgagctgaccattaacgcggatttcggcgatctgtcggcgctgatgctgccgccaggaggtacacattgaacgcgctttcactcattaacagcgcgctgctgtttttttccgcggcggcgttgctggcagcggcattttcattttataagccgctgagcggcgtgatggcagggctgggcggcgcgctcgccagcgtcatgacggcgggggccggcgcgctggtactgctcgacggcgtggcggtgcagggcacggtatcgctggcgggtatggggatgctgatcacgccgctgtctgcgatctggcttatcaccctcggcctgtgcgggctgtttgtcagcctgtttaaccttgactggcatcgtcatgccggggtgcaggcgaacggtctgctgatgaacgccctgatggcggcggcggtgtgcgctgtcgttgcagataactttggcgtgctggtggtcatggcggagatcatggcgctgtgcgcggtgtttcttaccggctgcggccagtcggcaaaactgtggtttgtgctgggccgggcgggcacgctgctgctggtcgtcagctgcgggctgatctggcagcgttatcacacgctggatctgacgcagatgaatatggccgcccaacagttaccgctgagcgccgggatctggctcaccggcgtggccggatttggcctgctggcggggatcatcccgctgcacggctgggtgccgcaggcccatgcgaatgccagtgcgcccgccgcggcgctgttctccaccgtggtgatgaaaatcggtctgttcggcatcctgacattatcgctcgcgggcggtaatccaccgctgtggtggggcattgtgctgctggcgctggggatggtgacggcttttgtcggcggcctttacgcgctgatggagcacaatattcagcgtctgctggcgtaccacacgctggaaaatatcggcattattttgctcggtctgggggccggtctgaccggcatcgccctgcaacagcccgcgcttatcgcccttggcatgaccggcggcctctatcacctcatcaaccacagcctgtttaaaagcacgctgtttctcggcgcgggcagcgtctggtatcagaccggacatcgcgatattgaaaaactgggcggtatcggcaaacgcatgccgctgatctcgctcgccatgctggtggggctgatggcgatggcggcgctgccgccgctcaacggctttgccggggagtgggtgatctaccagtccttcttccgcctgagcagcagcgagctgtttatcggccgtctgctcggcccgctgttagccgtggggctggcgatcaccggcgcgctggcggtgatgtgtatggcgaaagtctatggcgtgacctttctcggcacgccccgcaccccggaggcggcaaacgcccgtcctgcgcccttgctgatgaccttctccgtggtggcgctggcgctgtgctgtatcgcgggcggcgtgggcgtgccctggctgctgccgctgttatcaacggcggtaccgctgccgcttgccaccgcgcagaccagcgtgtcacagccgatgatcgcgctgctgctggtggcctgtccgctgttgccgctgatcatcatgctgttgttgaaaggcgaccgtttaccgggacgccagcgcggggcggcatgggtgtgcggttacgatcacgagccatccatggtgatcaccgcccacggttttgcccatccggtgaaagccgcttttgccccggtgctgaagctgcgtcactggctggatccggtcgcccgcattcctggctggcagcatgaaggggcggcggtactgttccgtcgcctggcgctgatcgagctggcggtgctggtggtggttgtgatttcccgaggagcctgaacatgaatctgctgtttccgttacttcaggcgctggcgctgtttgccttcgcgccgctgctgtccggcgtaacccgcgtggcgcgcgcccgtctgcataatcgccgcgggccgggggtgctccaggaataccgcgacctgatcaagctgttcggtcggcagagcattgcgccggacgcggcgggctgggtgtttcgcctgatgccgttcgtgatggtcggcgtgatgctgaccatcgccaccgcgctgccggtgatcaccgtcgcctcgccgctgccggtgctgggcgatctgatcaccctgatttacctgttcgccattgcacgcttcttctttgccatcgccgggctggataccggcagtccctttaccgggctgggggccagccgtgaggcgatgctcggcgtactggtagagccgatcctgatcctgggactgtgggtcgccgcgctggtggcgggttcgacgcacatctcttatatcgccgccgcgatttaccactggcccgccgggcgcagcctgccgctgatccttgcgctctgcgcctgtgccttcgccacctttattgagatgggcaaactgccgttcgatctcgcggaagcggagcaggagttacaggaagggccgctgaccgagtacagcggcagcggctttgcggtgctgaagtggggcatctgcctcaaacagctggtggtgctgcaactctttgtcggcgtctttttcccctgggggcagatgatgcacttcagcgtgaccggcctgctgctggcgctggtgattgccgtggtgaaactgcttgtcggcgtgctggcgatcgccctgtttgaaaacagcatggcgcggctgcgtttttgcgccacctcgcgcgtcacctgggccggtttcggctttgcctttttagccttcgtctccttgctggcggcgtgatttaagagaacttatgtatgtctgaagaaaaaatcggtcaacactacctcgccgccctgcatcaggcctttccgggcgtggtgctggatgaagcctggcagacccgcgatcagctcaccctgacggtgaaagtgaattatctgccggaagtggtggagtttctctattaccagcagggcggctggctgtcggtgctgttcggcaacgacgaacgccagctgtgcggccattacgccgtctactacgtgctgtcgatggagcagggcatcaaatgctggatcacggtgcgggtggaagtggacgccagtacccttgagtttccatcggtgacgccgcgcgtaccggcggcggtctggggcgagcgcgaagtgcgcgacatgtacggcctgcgcccggttgggctgccggatgagcgtcgcctggtgctgccggatgactggccggacgaactctatccgctgcgtaaagacagtatggattaccgtcaacgcccggccccgaccaccgacagcgaaacctacgagtttattaacgaactgggcagtaagaaaaataacgtcgtaccgattggcccactgcacgtcacctccgacgaaccgggccatttccgcctgtttgtcgatggcgaaaacattatcgacgccgattaccgcctgttctatgtccatcggggcatggaaaaactggcggaaacccgcatgggctataacgaagtgactttcctgtcggatcgcgtgtgcggcatctgcggctttgcccacagtaccgcctacaccacctcggtggaaaacgcgatgggcattaaggtgccggagcgtgcgcagatgatccgcgccattctgctggaagtggagcggctgcacagccatctgctgaacctcggcctggcctgtcactttgtcggctttgactccggctttatgcagtttttccgcgtgcgcgaaacctccatgaaaatggcggagatcctcaccggcgcgcgtaaaacctacggcatgaacctgatcggcggcattcgtcgtgacatgctgaaagacgacatgatccagacccgtcaactggcgcagcagatgcgccgcgacgtaatggaactggtggatgtgctgatgagcacgccgaatatcgaacagcgtaccgtcggcattggccgtctggatccgcaaattgcccgtgacttcagcaatgtcggcccgatggtgcgcgccagcggccatgcgcgcgatacccgcgccgatcacccgttcgtcggctacgggctgttgccgatgacggtgcacagtgaacagggctgcgacgtcatctcccgcctgaaagtgcgcatcaacgaagtgctgaccgcgctcaatatgatcgactttggtctggataacctgcccggcggcccgctgctggtggagggctttacctatatcccgcaccgttttgccctcggttttgccgaagcgccgcgcggcgatgatattcactggagcatgaccggcgacaaccagaaactctaccgctggcgttgccgggcggcgacctatgcgaactggccgaccctgcgctatatgctgcgcggcaatacggtatccgacgcgccgctgatcatcggcagcctcgacccctgctactcctgcaccgaccgtatgacggtggtggatgtgcgcaggaagaaaagcaaagtggtgccgtacaaagagcttgagcgctacagcatcgagcgtaaaaactcgccgctgaaataaggagtcgccatgtttacctttatcaaaaaagtcatcaaaaccggcgcgccgacctcgtcgtacccgctggagccgattgccgtcgataaaaattttcgcggcaagccggagcacaatccgcagcagtgcatcggctgcgccgcctgcgtgaacgcctgtccgtcaaacgccctgagcgtagaaaccaatctggcccgtggcgagcaggcctggcagtttaacctcgggcgctgcattttttgcggtcgctgcgaagaggtctgtccgacggcggccattaccctgtcccaggcctatgaactggcggtatggaagaaagaggatttcctgcaacagtcgcgctttgcgctgtgcgaatgccgcgtctgcgcccggccctttgccgtgcaaaaagagatcgactacgccatcgccctgctgcaacacaacggcgacacccgtgcgcacgagcaccgggagagcttcgaaacctgcccggactgcaaacgtcagaaatgcctggtgccgtcagatcggatcgaactgacccgccacatgaggaaggccagctaatgcaaaacctaattggaccgcgtgacgataacggcattccggtgccgatgacggtggatgaatccatcgcgcgcatgaaaacctcgctgctgaaaaacatcaagcgttccgcctatgtctaccgggtggactgcggcggttgcaatggctgcgaaatcgagattttcgccacgctttcgccgctgttcgacgccgaacgcttcggcatcaaagtagtgccgtcaccgcgtcatgccgacattctgctgtttaccggtgcagtgacccgcgctatgcgctcccctgcgctgcgcgcctggcagtcagcgcccgatccgaaaatctgcatctcttacggcgcctgcggcaacagcggcggcatcttccacgatctctactgcgtgtggggcggcaccgacaaaattgtgccggtggacgtttatattccgggctgcccgccgacgcctgccgccaccctgtatggctttgccatggcgctgggcctgctggagcaaaaaattcacacccgtctgccgggtgagcaggacaaccagcctgctgaactgttgcatgacgacatgatgcagccgctgcgcgtgcgggtggatcgcgctgcccgccagctggccggttatcgctatggccgccagattgccgatgattatctgcggctgctgggcaagggcgaacagcaggtggcgcgctggctggaagcagaaaacgatccgcggctgaatgaaatcgtgcagcggcttaacagcgtggtgaacgaggcgcgcatcagatgagcgagaaggtcgttttcagtcagttgagtcgcaaatttgtcgacgagaatgatgccacgccgcccgccgcgcagcaggtggtctattacagcctggcgatcggtcatcacctgggggtgatcgactgcctggaagcggcgctgacctgcccgtggcaggcgtatctggcgtggatcggtacgctggaggagggcagcgaggcgcggcgcaaaatggaaggcgtaccgaagtatggcgagatcgtcatcgaccattcgcacatcagcatgctggccaacgcctttgatcgcgcccgggcgcagcagacgccggagcagcaggcctggagccggacgctgctcggtatgctgcacgatatttatcaggagaatgccatctacctgatggtgaggagattacgtgactgatgttttactctgcgtcggcaacaccatgatgggcgacgacggcgcaggtccgctgctggcggaaatatgcgcggagcggggctgtgaagggtggacggtgattgacggcggcagcgcgccggaaaatgacatcgtggcgatccgcgagcttaaacccgcgaggctgatgattgtcgatgccaccgacatggggctgaaccccggcgagatccgcattatcgatcccgatgacatcgccgacatgtttatgatgaccacccacaatatgccgctcaactatctggtcgatcagttaaaagacgatgtcggcgaggtgatttttgtcggcattcagccggatattgttggcttttattatccgatgacgccgccggtaaaggcggcggtggaaacggtgtatcagcgccttgccggatggcaggggaacggcggtttttcaccgctgtgattgaaactctgcccggtgggaaatgccgggcggcgctgcgcttgcaccggcctacataatttcgacaatgcggatttttgtaggcccggtcaggcgaagccgccaccgggcaatgcaatttattccaaatccgcgccattactggcaatcactttcttataccaccagaaggatttcttgcgcgtgcgggcgagggtgccgttgccggcgtcatcgcgatccacatacacaaaaccatagcgcttgctcatttcaccggtggatgccgataccagatcgatacagccccatgaggtataacccatcagcggcacgccgtcttcgatggcgtcacccatcgcgcggatatgctcgcgcagatagcttatgcggtaatcgtcgttgatctcgccgttggcatcgatttcatcccgcgcgccgaggccattttccaccaggaacagcggcttctggtaccggtcatacatcatattcatggtgatgcgtaagcccagcggatcgatgccccagccccattcgctggcctgaatgtacgggtttttcagtgacttcacgatattggccgcgctggtgtttccggcgttcatatccgctgacgcgcagcgggaggcgtaatagctgaacgacacgaaatcgacggtgtttttcaggatctcatcgtcgcccggcgctttttcaatgtgtacgcctttctcgcggaacacgcgggcggaataggacggataggccccgcgcgcctgcacgtcgataaagaacaggttttcgcgatctttctccagtgccatccacacatcttccggcttgcaggaatacgggtaaaaattaccgcccgccagcatacagcccacctgattgtgcgggttcacctcatgggctattttagtcgccagcgcgctggcaatcagctcatggtgcgcggcctggtatttcacctggtcctgattttcaccttcttcaaacgccagtcccgcgccggagaacgggctgtgcagcatgatgttgatttcattgaacgtcagccagtacttcaccagcccgtcaaattcttcaaaacaggtgcgcgcatagcgggtgaagaactccaccatcttgcggttgcgccaggagccatattccaccaccagatgcatcggcacgtcgaaatggcacagcgttaccagcggttcaatgttgtactttctgcactcctcaaacaccgctttatagaaggcgatgccttccgggttgggcgtcagttcgtcgccattcgggtacaggcgcgcccaggcaatggaagtgcggaacaccgtgaagcccatctccgccatcagggcgatgtcttccttgtagcgatgataaaaatcaatcgcctcatggctggggtagaactcatcatcacgcagcgccacgcgcttttcctggcccagcttcaccggcaggcggtttgcgccatgggggatcatatcgacggtggtcaggcccttgccgccttcgcgatatgccccttcagactggttggcggccagcgcgccgccccataaaaatccttccggaaatacagacatgcttacttctccttaaatcaggctctggcttcggtgctgacgggcgctttcgccgcctgcaactcacgcgctttcgccgcttctttttccaccggaatatcttcaaagcccagcatcagcgtgagcacaaaggacagcaccaccgccagcgccatcacgccgaacacccagacgatgctcatcggattggccggatcgaagaactgcacgctggtaaacagtccgggtgctgccattgaatggctggcgagtccggcaatgcccgccaccgcgccgcagataaagccgctgatgaggctggcgataagcggtcgtttcaggcgtaccgccacgccgtacagcgccggttccgagatgcccgccagaatggcagaggcggcggctgccagcgccgtctgacgcagttccgggtttttcgttttccacgccaccgccagtgaggagccgccaagggagaggttagcgccaatttctgacggcatcaccatgccttctttaccggtttcggcgatggtctgaataatagtcggcgtaaacacgcggtgcatcccggtcatcaccagcagcggccacagcgcgcccataatggcgacggacagccagccaagataatcgtgaatggtgtacaccagcgcagagatggcgctgccgatccagataccgattgggccgatgagcacgatggcgagcggggcggcaatcagcacgatcagcatcggcttgaggaagtttttcgtcaccgccggggtgatcttatcgacccagcgttcgatataagacaggcaccaggtcatcaccagcgccgggatcaccgtgtaggtgtacttcaccgccgtcaccgggataaaggcgaattcgacgtgctcgccctgagccgctttcgccatcagctcgataaagctcgggtgcaccagcacaccggcaatggctatcgccagcgacatgttggttttaaatttgatcgccgccgaagccgccaccatcagcggcaggaagaagaaggccccgtcgccgatcaccgtcaggatggtcagcgttggcgcgcctttttccagcacgccggtcatctccagaatcatcgccagcagcttgaccatcgatccgccgatgatcgccgggatcaacggggacatggtgccgatcagcgcatccagaatacctgcgccgatgcgctttaaggtcagtttctgttttgatgcggtttccaccggctgcatatctcccggcagcaggctcaccacttcgcggaacgcctgcgagaccgtgttgccgatgatcacctggcactggttatcgttacgcaccacgcccattacgccgctgatgcttttcaggccgggagcgtcgatgagcgattcatcttttactacaaagcgcagacgcgtcatgcagtgcgtcacggcagcgatattgtcaacgccgcccagcgcagcaatcacagagtgggcaagcgccgcataattcttagccatcgggaagtaatcctgttttatcagtaagatacgctttcattgtcagacaatgacacagcagataggaaaccggttccacaaaagaatgattagttcttgtaaatcaaacaatgatttttatattgatttgtgatgaggttcgctaaatatttgattggctgtaggccgggcaagacgtagtcgccgcccggcaccaaagctgcaaactgcgtgactgtgaagtacactgccgcttatcgacattaaagggataatgatcatgacgacgatgctggaggtcgcgaagcgggcaggggtgtccaaagccacggtatcccgcgtgctgtcagggaatggctatgtgagccaggaaaccaaagaccgggtatttcaggcgattgaggagagcggctaccggcctaatttgctggcgcgcaatctggcgacgaaaaagacgcagacgctcggtcttgtggtgaccaacaccctctattacggcgtctatttcagcgagttgctgttccatgccgcgcggatgacggaagatcatggccgccagctgatcctcgccgacggtaaacacagcgctgaagaagagcgtcaggcgatccagtatttactcgatatgcgctgtgacgcgatcattatttatccccgttttctcagcgtcgatgaactggatgcgcttgttgaaaatcacacccagccggtaatggtgcttaatcgtcggctgcggaaaaacagcagccactgcgtctggtcggatcaaaaacagtccagctttaaagcggtgtcgactttattagcccgcggccaccgggatattgcttttattaccggctcgctggattcgccgaccggtattgaacgtctggcgggctataaagatgcgctggcgcagcatggcgttgcgctgcgcaacgatctgattgtcgaaggaaaatggacgcctgccagcggcgctgagggcgtgaaaacgctgctctcacggcagcaaagctttaccgcgctggtggccagtaatgacgacatggcgattggcgcaattaagcagctgcatgaggcgggaataacggttcccgaacgggtttccgtgctgggattcgatgatattgcgctggccccttatattgtgccgtcgctgtccagcgtgcgtattccggtcacggaaatgatcaaagaaaccattaaccggttaatctttatgctcgacggcggtgaatttaaatatcagcaaacctttgccggggaattacattcccgcgactccatcattgacgggccacacgcctgacgtcgacaggtgtcatcgtcactcgtgtcgatgacacttcctttctgcctcgtcttttctaaaatatacataaatatcaatacattaaaatctggcacgattcatgaatagctccgcggtaacctttacagccggagaacccgatgaaccgtttcatcatggcggatgccaataaatgcattggctgccgcacctgcgaagtcgcctgcgtggtttcgcatcaggaagatcaggactgcgccgccctgacgcccaccacctttctgccgcgtatccatgtgattaaaggcgtgaatatctccaccgccaccctgtgccgtcagtgtgaagacgccccttgtgccaacgtctgcccgaacggcgcaatcagccgcgataaaggctttgtgcatgtgatgcaggaacgctgcatcggctgcaaaacctgcgtggtcgcctgcccgtatggcgcaatggaagtggtggtgcgcccggtcgtgcgcaacagcggcgcgggcctgaacgtgcgcgccgaaaaagccgaagccaacaaatgcgatctctgccatcaccgtgacgccggtccggcgtgcatggaagtctgcccgacccgggcgctggtctgtgtcgaccgcaatatgctggaaaaaatgagcgccgataaacgtcgtcgttccgccctggataccaccggcatgctgttttaacccgaacccgatttcaacttttaacaggtctgttactgatgaaaaaaatcacaagcgtatgtccctactgcggcgcaggctgcaaacttaaactggtcgttgagaacaataaaatcgtgcgcgcggaagccgccgaaggggtgaccaaccagaatcagctgtgcctgaaaggctattatggctgggattttctgaacgatactaagctcctcacgccacgcctgacgcagccgatgatccgctacgaaaaaggcggcaaactcacgccggtcagctgggacgaggcgatccgctataccgcaaaacgcctgggcgagatccgcgcgcagttcggcccgcgcgccatcatgaccaccggttcgtcccgcggaacggggaacgaaaccaactatgtgatgcagaaattcgcccgcggcgtgctcaataccaataacgtcgactgctgcgcgcgcgtctgtcacggtccatcggtggcgggattgcaggaaacgcttggcaacggcgcgatgagtaactccatcggcgacattgaaaattcccgctgcctgctggtatttggctataactgcgcggattcgcatcccattgtggcgcgtcgggtgatcaaggcgaaacagaacggcgcgaaaattatcgtctgcgatccgcgccgtatcgaaaccgcgcgcatcgccgatcagcatctgcaaatcaaaaacggctgtaatatggcgctggttaacgcctttggttatgtgctgctggaagagcagctctacgacaaagagtacgtcgccagctttaccagcgggctggacggctaccgggaaacggtaaaagattatgcgccggaaaaggtagagcacctgaccggcgtgtcggcgcagcagatccgtcaggcgatgcgcacttacgccgccgcgccgtcggccaccattatgtggggcatgggcgtgacgcagttcggtcaggcggtggacgtggtgaaagggctggcgagcctggcgctgcttaccggcaatctggggcgcgagcacgtcggcgtcgggccggtgcgcgggcagaataacgtgcagggggcgtgtgacatgggcgtcatccctaaccagttccccggctatcaggatgtggtggatccggcggtgcgcgcaaaattcgctgccgcctggggcattaaccctgacgatatggacgataaacccggcgtgcgcatcaccgaagtgccgcatctggccatcgaaggcaaagtgaaagcctattacatcatgggtgaagatccattgcagaccgaagcggatctgggcctggtgcgcaaaggctttgcggcccttgattttatcgtcgtgcaggacattttcatgaccaaaaccgccgagcaggcggacgtgatcctgcccgccacctcctggggcgagcacggcggcgtctttacctgcgccgaccgcggcttccagcgcttcgaaaaagccattgagcctgcctataacgtcaaacgtgactgggaaattatcagcctcatcgccactgagatgggctacccgatgcactacgacaataatcagcaaatctgggatgaactgcgcgagctgtgcccgctgttctatggcgtgacgtatgaaaaaatgggcgatatgggacacgtgcagtggccttgcccgaccctcgatcaccccggcacgcctttcctctacaaaggcaataaatttgatacgccggacggcaaagggcatctgtttgccgccccgtggcgcgcgcctgcggaagtgccggacgccgactacccgctggtgctgtgcaccgtgcgcgaagtggggcactactcctgccgctcgatgaccggtaactgcgcggcgttgcaaactctggcggatgagccgggttttgtgcagatcaacccgcaggacgcccgtgcgctgggcattcaggatcggcaactggtgtgggtttcctcgcgccgtggcagggtgatcagccgtgccgatgttaacgagcgtatcaacaccggcagcgtgtacatgacctatcagtggtggattggcgcctgtaatgaactgacccaggacaatctcgatccgatctccaaaaccccggaaaccaaatattgcgcggtgaaggtgagcgcgatcgacgaccagcgctgggcggaagattacactcagaccacctatctcgagatgaaaaaccggctgcgtgatgcagtggtatgacaggacagaatgagtaataacggcgtactgatacgtgtacgcggcaaggtgcagggggtgggtttccgccccttcgtctggcagctggcgcaacaactcgatctgcgtggcgatgtctgcaacgacgggcacggcgtcgaaatccggctgtccggcgacgccacgcgttttcttcgcgagctgtatcagtactgcccgccgctggcgcgcattgacgatacggaggtgaccccctggcagtgggacgacgcgcccaccgccttcactattcgccacagcaccggcggcagcatggacacgcagattgtgccggacgccgccacctgcccggcctgtctggcggaaatgaacgatcctgctgagcgccgctatcgctatccctttattaactgcacccactgcgggccgcggtttaccattattcacgccatgccttacgaccgtccgttcaccgtgatgcgcgcctttccgctgtgtccggtctgtgatgctgaataccgcaatccggcggatcggcgttttcacgcccagccggtggcctgcgcagagtgcggcccgcagcttgaatggcaggcagcaggggtaagcgaagcgggcgaggcggcattgcaggcggcaatcgccatgctggcggcgggaaatattgtcgccattaagggccttggcggttttcatctcgccgttgatgcgcaaaaccagcaggcagtgatgcgcctacgggaacgtaaacgccgtccggcaaaaccgctggcggtgatgatcccctgtggctgctgtgaggtggcagcagagcacctgcaatccgccgccgcgcccattgtgctggtggcgaaaagcgcgctgccggatctgtgcgaggccattgcgccttcgcttgcggaggtgggcgtgatgtggcccgccagtccgctccagcatttgctgatgcaggcgctggatcgtccgctggtgatgacctccggcaacctcagcggacgaccgcctgcgcttaccaacgaccaggcgctcaacgatctggcggacattgccgacggctttttgctgcataaccgcgacatcgtgcagcgcatggatgactcggtgatgcgcgtcagcggtgagatgctgcgccgggcgcgcggctttgtgccggacgcgctgccgctgccgccgggcttccaggatgtgccgccgctgctctgtctgggggcggacatgaaaaataccttttgcctgctgcggggcgaccgggcggtgctgagccagcattttggcgatctcaccgatgacggagtggaaacccagtggcgcgccgccctcgatctgatgcagaaaatttatgatttcgtgccgcagcaggcggtgtgcgatgcccacagcggctatcgcgccacgcaatggggcgaggcgctcggcctgccggtgagccacgtgctccatcatcacgctcacgcggcggcttgtctggcagaacaccgctggccgcgtgacggcggtgacgtgatcgcgctgatccttgacggtattggcatgggtgaaaacggtcgtctctggggcggggagtgtctgcgggtgaactaccgcgaatgcgagcacctcggcggcttaccggcggtggcgctgcccggcggcgacctggcggcacgacagccgtggcgcaacctgctggcgcactgtctggcctttgtaccggactggcagcgttatccccagacccgcgtgctacaggataaaaactggccgctgctggcgcgggcgatagcgcaggggatcaattcccctcgcgcgtcatcctgcgggcggctgtttgacgccgtagcctgcgcgctcggctgcgcgccggaaagcctgagctacgagggcgaggcggcctgtcagatggaggcgctggcaagtgaatgttccggtgtggatcatccggtggtgttgcagccgcaggatttgacgacgttctggcagtcgtggctcaggtgggacgcaacggtaagcgaaaaagcctgggcgtttcatgatgcgctggcaaaagggctggcggggctgatgcggcgcgaggcgcaggcgcgggggatcacgacgttgtgttttggcggcggggtgatgcacaaccggctgctggtggcgcgcttagggttttatctgggggagttcaggttgctgtttccgaaggggttaccggcgggggatggggggatcgcattggggcaggggattattgcggctgcacgcttggtgtaatgtggtaagttgcgctcttactgacttctgcgtacgactcagacttcaggcgcacagagcgcgcagggggcggccagtcgccgccgccccctgcacccccgggctcccggcaagaaaatcgccgcttcgcggtgccctcggcttatcccttccggcttcgggtcgggcgcgatgcagcgtccctgcaagtcgcgccctcagcccgcatccatgcgggctgccccggccgtaagggaacgcctcagcgattttcagccggactccccacacttcacgatttttaaaaaacaccactcacagcttcctgtaagttcgtaaaaaaattaacgccactccgtcgccttataaaaaataaagataatgacgcgaggggttgagtccccgctgaaaccggcgagccggaggccggatgacaagggctggacgccatggatggcggccagaggcgatatgaggcaggaggccgaattgagccgaccgcgggcagacgggcgggaggtgagcgcagtgcgcagcaccggtttctgtgcggggccgcggggattgctaagggggccgcggtggcccccttagcacgttcaccgtcagcggcgtcacgcctgacacggaacgcaaagtgaacggaatattccaccacaccgaacattccaccacaccaaacatcccaccgaacagccccaataaacctacccgttcagcgccttcagcaacccaaacgcctccttcatccgatcctcactcaccacaaacgcccgcagcttctccccctcaaaccccttcgccaccatcccgtccgggcgcgcctcgatctgccagtgcagatccccgcgctgtgtctcgcccgccagatgcagcggcagatccggcgtcttcactttcaccagcatcggcggcagcgacagcgtggcctgctggcccagcagcgtcttcgccagccacatcgcgcaaatctggatcggttgcaggaagggcagcagcttaccgttgatctccgcgcagtcccccagcgcataaatatcctcaatactggtgcgcagctgactgtcgaccacaatgccgcgtctgacggcaatacccgcctgactcgccagcgcggtttgtggtttcaggccagtggcggccaccaccgcatccacctcaaggaggcgatcgcgatcaaaacgcgcctgaatgcccccggcggtagactccagcccaagcaactgcgatttcagcagcagatgcacgccgctctccgtcagacggtgttgcaggcggctgctcacttccggcggcatcagcgaagaaagtatgctggcggcggtatccaccagcgtcaccgttttaccggcgcggttaaaatccatcgccagctcagtgccgatcagcccgccgccgacaatcagcacgcgctgcgcatcgcgcagggtcgcgccgcacgcctgatactcctgctgactgttcagcgtcagcatcagctcgctgcccggcaccggcggcacaaaggccgaagcccctgtcgccagtaccagcttgtcgtaaaaccactcctgctgctggcttttgacgcagcggcgggtgggatcgatttccgtcacccgcgtctgcgggaacaggcgcagattgaactgttccgcaaactcccccgccgactggcgggtgagatcgtctgcggactggccgaggctgatcacgtggctgagatccggtttgttgtattcgtccatgctgtcagcggcaatcagcgtgaccggaacctgcgcgtcctgtttgcggatattttttaccagctgtcgggcggcgaagcccgaaccaataatgacgataccctgattcattttgcctccacggccagcacatcaaacacgtctttacccagtgaacattccgggcacaggaagttgtccggcacctcgtcccacggcgtgccgggggcgacatcctgcattggctcgccggtggccggatcgtagatccactgacaaacgctgcactgcatgcatgggccgaggtcagcggcggcaggctcgctgacgctttcttcctgcggttttacgttcggggcagcagcggaaggcagcggggtaagcgcccactgacgggcaatatcacgaccgtgctggcggcagatttccagcgcatcaatatccggacgccatttggctttcaggctgagtgacatttcaaaaccggcatcctgtaaacgcgtagacaggcggtccaccgcgccgccgctccagccgtgggagccaaaggcactggcgcgtttattgcggaagcgcagcccggttatctcttccaccagcccggcgattttcggcatcatcacgttattcatggtggaggtacccaccagcacgcctttggagcggaacacgttggtcagcacctcgtttttatcgctgcgggcgacgttgaagattttcaccgccacgcggggatccacttcggtgatgccctgggcgatggcgtcggccatcatgcgggtattgttcgacatggtgtcgtagaaaatggtgatgcgatcttcctgataatccgctgcccatttcaggtacagctcgacgatttgcgtcgggttatcacgccataccacgccgtgagaggtggcgatcatatccaccggcaggttaaagccgaggatttcggtgattttcggcgtcaccaggcggctgaacggcgtcaggatgttggcgtagtagcgctggcactgctcgaacagttccacctgatccacttcgtcattaaacaggtgttcgtcgcaatagtgctgaccgaaggcgtcgttactgaacagcaccgcgtcgccggtcatgtaggtcatcatgctgtccggccagtgcagcatcggggtttcaacgaagatcagctgtttaccgttaccgatgtccagcgtgtcgccggttttcaccacgttaaaattccactccggatggtggtgatgaccgttgatggaatcgatggcgttattggtgcagtaaatcggcgtgtccgggatgcaggacatcagttcggtcagcgcaccggcgtgatcttcttccgcatggttgatgatgatgtagtcaatatccgcaaggtcgatttcagcgcgcaggttctgcacgaattcacggctgaatttgtggtcaacggtatcgatgagcacgtttttctcttcgcggatcagatagctgttatagctgctgccgcgcagggttttgtattcggtaccgtgaaaatcgcgcacttcccagtcacgttgtccaacccagtgaatattattttttacatgaatagtcatattaacctcagccactctgaatttgagaaagatgtctgacatatatcaagatgcgtgccagttttttattttatttaaaatcaatggtttgatagatttttggtaaaggtagtttgtcaaaatgactatgctttttatggtcaatatgacactatgcattgtcaaaatgactgtgaggtgggtatgcgtttttccgtggaagcactggcgaaaatcgccattgaactgcaaagcgatatcggtcatcaggatcgcttttcccggctgatcgccacgctgcgccaggtgctgggctgcgatgcctcggcgctgctgcgctatgaggcgcaccagtttattccgctggccatcgacgggctggcgcaggatgtgctggggcgacgcttttcccttgccggacacccgcgcctggaggccatcgcccgcgccggggacgtggtgcgctttccggcagacaacgatctgcccgatccctacgatggcctgatccccggccaggagagcctgaaagtgcacgcctgtctgggcctgccgctgtttgccgggcagaagctgattggcgcgttgactctcgacggcatggagccggatcaattcgacggcttcagcgacgaagccctgcgtctgatagccgcgttggtggccggggcgctgaataacgcgctgctgattgcccagctggaaagccagaacgtgctgcccgccggggaaagcagcttcacgccggagcgcggacaggagatgatcggcctcgccccggcaatgcagcagctgaaaaaagagatcgatattgtcgccgcctcagatttgaacgtgctgatcagcggcgaaactggcaccggtaaagagctggtggcgaaagcgatccacagcggatcgccacgggcggtgaatccactggtctacctgaactgcgcggcgctgccggaaagcgtggcggaaagcgaactgttcggtcatgtcaaaggggcctttaccggggcgatcagcaaccgcagcggtaagtttgaaatggccgataacggcacgctgttccttgatgaaatcggcgagctgtcgctggcgttgcaggcgaagctgctgcgtgtgttgcagtacggcgatattcagcgcgtcggcgatgaccgcagtttgcgggttgacgtccgggtgcttgccgccaccaaccgcgatttgcgtgaggaagtgctggcggggcggtttcgcgccgatctgttccaccgtctgagcgtttttccgctgtttgtaccgccgctgcgggagcggggcgaggatgtgatcctgctggcgggttatttctgcgagcagtgccggatgcggctcgggctggcgcaggtggtgctaagccccggcgcgcgggcgcagctgctggcgtatggctggcccggcaacgtacgcgagctggaacatgccattcatcgcgcggtggtgctggcgcgggcgacgcgggcaggggatgaagtggtgctggaagcgcatcactttgcctttaccgatgaggctgcgcctgcggcaacgcccgtcatcagcctgccagtgaacgacgccgcgctgaacctgcggacggctacggaagattttcagcgccagctgattgagaatgccctgcgcgcccacgaccataactgggcggcaagcgcgcgggcgctggagatggacgtcgccaacctgcaccggctggcgaagcgtctggggctgaagggctagagaatgcccgcctggtagaagtcctgtaagttgatagcgccggtgagcacgccgttttcatccaccaccggggcggcggcgattttgcgcttcatcaggatctctttggcatcaatggcgcggctctgcgcctgtagcgtgacgccgcccggcgtcatggcgtcacgtaccgcggcgtccagcgtgccgccgcccaccagccagcggcgcaggtcgccatcggtaaataccccctgaacgtgctgcgcgctgtcgcataccgccaccagccccagcccggtgcggctcagttccagcatggcgtccatcacgctggtgtcgagttgcacctgcggcagggcgtcaccggtacgcatcaggtgatgcactttattaagcaaccgcgcgcccagcgcccccgccggatgcgaacgggcgaaatcttcttcgttaaaaccgcgcgcctgcatcaccgccatcgccagcgcgtcgcccatcatcagcgtgttaacggtgctggaggtgggcgcaaggtgcatcgggcaggcttcacgctccaccgaaatgtccagccaggctttggcggccagcgccagcggggagcgggatttaccggtcatcgccagcagcgcgacgcctttttcttccagccgcgggatgatcagatccagctctttggcggtgccggaataggagataaacagcagcaggtcgcggctttcaatcatgccaagatcgccgtgcagcgcttccgccgggtgcacaaaaaacgccggggtaccggtgctggcgagggtggcggcgatcttcttgccaatgtgtccggatttgccgatgccggagacaatcactttgccttcgcagtgcaggatggcgctggcggcgcgcacgaagtcgtccccgaggcgttccggcagacggctggcttcctgtaattccagcagcagggtctggcgggcggtatttaacagatgttcactcatggctctctccggcaataatcacatcaattcctttgtcttccagtgcggcgcggaactcttcggaaattcccgcgtcggtgatcagtttatccacgctctccaggctacagacgatattcgggcttttgcggccaaactttgaggagtcggccatcaggatcacttccctcgcggcgttgcacatggctttactgacggtaaacacttcgttgaaggtggtgacgcccgcgctgagatcgatgccgtcggtgcccataaacagcttatcgaagctgaaatgctcaaaggcgttttccgccagctggccgtggaaggaggcggattttttacggaaagtgccgcccggcatcagtatggtctgctcgttgtccagctccgacagggcgttaacgatgtgcaggctgttggtcatgaccgtgatgttattaaagcggctgagcagaggcaccatttgcagcaccgtactccctgcgtcgaggatcagcgaatcgccatcgtgaataaagcccaccgccgtttcggcgatgcgcgctttctgagtggtgttaatcagcgctttatgatcgataggcggatccgcttcgtccttattaagcacgacgccgccataagtgcggatcaccgtaccggcgtgttcgaggatcaccagatctttgcggatggtggtgccggtggtgtcgaactgctgcgccagttcatcaaccgaacattttccccgctgatgcagatgttcgagaatagcggcctggcgctgacgtggtttcataagcgtggatcctgcgtaaaagtgcgaactgataatttcgcaagctaaaagcgttcacaacgaaattacccatgtttcattttaagcgctaatgatagagcattctgacagcgcggatcatggggaaagatcacatcagggcgtaattcatcacgatgtttgccggtaagcgcggaaatttttaacggtctggcgaaaaccgtcagtcctttcatcaataaggtgtccgtcacgcgctgctgttcatccagcgcgacggcgatgaccacgcggggctgaaaacgtccgccagcccgcccgacgccgacccgcccgcgctggcacagctgctcaaaggcgcggttaaactggcggatctgccagccgcccagcgccatctggccgatccaggcgatggcggcgacggtgataagtgccgttaccatagtgactccttaattgccggaattgccgggtggcggctgcgccttacccggcctacggtcatggagggttgtagccccggtaagcgcagcgccaccggggaatgaactcaaaacatcacctgcccgccggtgatattaatcgactgcccggtgcagtaagacgccagcgggctggcgtaaaacagcagcaggttaagcacatcctgataatcgcagccgcgcttcagcggcactttatcaatgtaatgctgctccacctgatcggcgggaataccgagcttgctggcatactgcgggatcagcgactggaacatcggcgatttcagcagattaccgagcatcagcgagtgcacggtaatgccgtactccgccagatccagcgccagcgactgcgttaaccccacgccgccgaacttggcggcgctgtagccggaattgtgtttgctgcccactttgccggatttcgagttgatctggatgatacgcccggcgatgccgtcgcggatcatcagccgtgaaaactcccgcgcacagaggaaatagcccaccagattcacctgcaacgagcggtcaaaatcccccagctcgacgtcgctgataaaggccgctttggcgatcccggcgctgtataccagcaaatcgacgcggccaaaaatctcgtccacgcctcgggagagcgccagcacgctctgttcgctggtggcgtctgccccgaaaccgtacgccttaccttcgccgaattcggcattgatctgctgtgcggtgctggcggctttatcgctctgaatatccaccaccgccacccgataaccctctgcggccagcccacggcacaggaacgcccctaaggtctgtcctccgccaatgacaacggcaacctgatccatacttttctcctcaactacgcagtaaattttaaaatgcagcccggctggatcgccgatggcaccggcccggcgacgtgcaccgtaccggggaattccgcctcgcgttctccgtcaaaccgcagggtgatatgacccagctcgcgcaggttttcgcccgccaccgcccccacggcggtgacgggatagcgctgttcccccagctcgaataccgcgccgggttgcaggctgccgtgcatttcgccgtggcagtgaataaagcagaacgcctgaatgtcggccggcgcgccctcgcgaaaggtgatcagcatcttttcgtccagcgcctccgctgcgctgtcgccaatatgggtgatggtggtctggtagatcacggacatcgtttatgacctcttattgatagatgaaacctgaaacaaaccaggcgataaggacggtaggcgcgccggtgagaaaacggctgaccagtacagaaggaacgccgacgcgcaccgtgtcctgacgcgcttccgccagtgacagccccacaggaatgaagtcgcacgccgcctgggcgttaatcgcaaacagggcgggcagggcgagatgcggcgggatgtgcccgaggccaatctgtacgccgatcagtacgccaatcacctgggcgatgaccgcgccagggccgaggaagggcgacagcagcgggaaggagcagatcagcgccagcgtcaccagccccagcggatggctggcgagcggggcgaggccgtgggcgatccagtcgcccagaccggatgccatgatgatgccgatcagcgccgcaacgaacgccataaacggcaggatggttttcagcaccgtatcaatggtgtcgcgcccggcctgaaagagtaccgccaccgccgagcccatccccatgccgaccttcgccagcaggccgtcgctctgctcggtgatcttcttactggtgtcgtaatcccgcggcgcaggatttgccgtggcggcctgttcgtggcgaatgttttcctctttcacgccggagacgtaaatgtcttcggtgatgtactgcgccagcgggccggacttgccggtggcatgaatattcaccgtcggaatacggcgtttcgggtagatcccacagcgcagggtgccgccgcagtcgatcaccgccacgccgatctctgcttccgcaggttctccctctttgaagccgtccaccgcctgccagccggtaagctgcgccagcttgtcgacgatggccgggcgcgttccggccgtgatatagacgatttttttcggcgtggtggcgtcaatcgtcagcgggccgccccagccgccggtgcccttttcaatcacaatgcgcgtcatgatgttgctcctgccaggcggactttctgctccagttgaatgcccatttttttctcaaaaatggcggtggtgaggtcagtgacccagccgcgaaagaagttggtgacgaggccgaccagcaggtagctcaccgccagcgggccgaggggtaaacccagcgtagtgaggccgctggcgatgcccagatacacaaacagctcgccgggattaatgtgcgggaacaggccgttcatcgagtggcagctataggacgcggcggcgtaatagctcggcttgtatttttccggcataaaacggcccaggctgagcgtcatcggattacagaacacaaaagtgccgaccagcggcagcagcagatagcgggtaacgggattaccggcgcagccctgcgccagtcgttcgatgcgttgctgaccaataaagttaatcagcgcgttcatgatcaccagcagactgatcagcaacggcagaatgcccgtcaccatgccggtaaatacttcgccacctttctgaaacagcccgataaaccactcggcgccgtgcgtgatggtttcgatcattcttttctcctccagggtagggtcttttgcacggctaataataatcactttgaaaggtttgaaagtgttattcatatctcattatgaaagataaaatgatcgaaatgaaagattttaaggaaaagaaggggagtaaacgttcgttttgcaagatttaggcggggcgcaggagaatgttgcggcgacttctctttgccgcttccttgtggacaggcagatgctttaccataattccctctcgccgaattcgttatcttatatggatgtcccatgtttaagcgtcgttacgcagctcttttacctgtgctggttctgctctccgcctgtagcagtaaaccaaaatccactcaggctcctgccactgcgggcacgccgccttccggcggattcctgctggagccgcagcatactatgctcaatccggccggcgattttgccaacaacccggcggctgaacagttcatcaatatgatggtcagcaaacacggttttgaccgtcagcaactgcatgagatcctctcgcaggcgaagcgccttgattccgtgctgcgcctgatggatcgccaggcgccgaccgccagcgtaccctcagggccaaccggtgcctggctgcgttaccgtaaacagttcatcacgccggataacgtgcaaaacggcgtagccttctgggatcaatatgaagatgcgctcaatcgcgcgtggcaggtgtacggcgtgccgccggaaatcatcgtcggcatcatcggcgtggaaacccgctggggccgcgtgatggggaaaacccgcattctggatgcgctggcaaccctgtcattcgcctatccgcgccgcgccgcctatttctcttccgagctggaaaccttcctgctgatggcgcgcgatgagagcgacgatccgctcgatttgaaaggttcttttgccggggcgatgggctacggacagtttatgccgtcctcctataaagagtatgccgttgattttaatggcgacgggcatatcaacctgtgggatccggtggatgctatcggcagcgtggccaactacttcaaagagcatggctgggtgaaaggcgatctggtggcagtaccggccatcgggcaggcgccggggctggcgaacggcttcaaaaccaaatacagcgttgcgcagctggcggcggcgggcttaacgccgcagcaatcgctgggtaatcatcaggaagcgagcctgctgcgcctcgatgtgggcaccggctacgaatactggtacggtctgccgaacttctacgccataacccgctataaccacagcacccactatgcaatggcagtctggcagctcggtcagacggtggcgctgtcgcgcgttaagtaataacgataaaggccggcgtccgctggccttttttctgaagccccctcgtaaaatcgacttcccgcccccacctttattgagaagatgctatcttgtctgccatgtttttattcacttacgggagtcatgatgacagacagtgaattgatgcatctgagcgagcgtatcggacaggcgctcaaagcgcggggcgccacggtcaccaccgctgaatcctgcaccggcggctgggtggcgaaagtcatcaccgatattgcgggcagttccgcctggtttgaacgcggttttgtcacctatagtaacgaagcgaaagcgcagatgattggcgttaagcccgccacgctggaacagcatggcgcggtgagcgagccggtggtggttgagatggcgataggcgccattaaagccgcccgcgcggactatgcgatcgccatcagcggcattgccggaccggacggcggcacggctaccaagcccgtcggcaccgtgtggtttggctttgccagcgccgcaggcgaggggatcacccgctgtgaatgcttcagcggcgaccgcgaaaatgtgcgtcgtcaggccacggcttatgccctgcaaacgctatggcaacaatttctacaaaacacttgatactgtatgagcatacagtataattgccgcaacagttaagaattcccggttgagcaccacctgctttacccggcatgacaggagtaataatggctatcgacgaaaacaaacagaaagcgttggcggcagcactgggccagatcgaaaagcaattcggtaaaggctccatcatgcgcctgggtgaagaccgttccatggatgtggaaactatctccaccggttcgctttctctggatattgcactgggcgcaggcggtttgccgatgggccgtatcgtagaaatctacgggccggaatcctcaggtaaaacaaccttaacccttcaggttatcgcggcggcgcagcgtcagggtaaaacctgtgcgtttatcgatgctgaacatgcgctggatcctgtctacgcacgtaagctgggcgtggatattgataacctgctgtgttctcagccggataccggtgagcaggcgctggaaatctgtgacgcgctcgcgcgctcaggcgccgttgacgtgctggtggttgactcggttgcagcgctgaccccgaaagccgaaattgaaggcgaaatcggtgactctcacatgggcctcgcggcacgtatgatgagccaggcgatgcgtaaactggcgggtaaccttaagcagtccaatacgctgctgatcttcatcaaccagatccgtatgaaaatcggtgtgatgttcggtaacccggaaaccaccaccggcggtaacgcgctgaaattctacgcttccgtgcgtctcgacatccgccgtatcggcgcggtgaaagagggcgataacgtagtgggcagcgaaacccgcgtgaaggttgtgaagaacaagatcgccgcgccgttcaaacaggctgaattccagatcctctacggggaaggtattaacttctacggcgaactggttgacctgggcgtgaaagagaagttcatcgagaaagcaggtgcatggtacagctacaacggtgagaaaatcggtcagggtaaagcgaacgccactacctggctgaaagagaacccggaaacggcgaaggaaattgagaagaaagtgcgtgacgcgctgctcagtaatccggataccaagcctgacttcaccgttgatgacaacgatgaacacgcgaaagaaggcgacgaagatttctgataatcttatgtaaccgataaaaagggctgcttatgcagcccttttgctattccattcccagcaggtgtgctatgtctgattctgatactacgccccgtcgttccgcctatgcccggttactggatcgggcgatgcgtatcctcgcgatgcgcgatcacagtgaacaggaatttcgccgcaaactcaccgcgcccgttatgaccaaaaccgggccggagccggtggatgccagcgaagaagatatcaataacgtcgtcaactggtgctttgaaaaccgctaccttgatgacgatcgtttcgcccgccagtttattgccagccgcgggcgcaaaggttacggcccgtcgcgcatcagccaggagctaaaccagaaaggcattggccgggaagccgcgcaggcggcgatgcgcgagtgtgatattgactggacggcgctggctcgcgagcaggcctaccgcaaatatggcgagccgctgcccaccgccttcgccgataaagtgaaagtacagcgatttctgatgtaccgcggctttatgatggaagatattcaggcgctgtggcgaaattttgatgattgactgcatacgggattttacttcgcagtaaagaaaacttatcttattcccactttttccggtagttggcggcggtctctacgcagtcaaccgccggctacgataatacgttagcttgatttcaggataattatgagcaagagcaccgctgagatccgtcaggcgtttctcgactttttccatagtaagggccatcaggtagttgccagcagctccctggttccaaataacgacccgactctgctgtttaccaacgccgggatgaaccagttcaaggatgtattccttggtctcgacaagcgtaattattcccgcgcgaccacctcgcagcgctgcgtgcgtgcgggcggtaaacacaatgacctggaaaacgtcggttacaccgcgcgtcaccataccttcttcgaaatgctgggtaacttcagcttcggcgattacttcaaacacgaagccattcagttcgcatgggaactgctgaccggtgaaaactggtttgccctgccgaaagagcgtttgtgggtaaccgtgtatgccactgacgacgaagcgtacgacatctgggaaaaagaagtcggcattccgcgcgaacgtatcatccgtatcggtgataacaaaggcgcgccatacgcttccgacaacttctggcagatgggtgacaccggtccgtgcggcccgtgcaccgagattttctacgatcatggcgatcacatctggggcgggcctccgggtagcccggaagaagacggcgaccgctacattgagatctggaacatcgtctttatgcagttcaaccgccaggccgacggcaccatggaaccgctgccgaagccgtccgtggataccggtatgggccttgagcgtattgccgccgtactgcaacatgtgaactctaactacgatatcgatctgttcagcaaacttatcgaagccgtagcgaaagtgacgggcgcgacggatctgagcaacaaatccctgcgcgtcattgccgaccatattcgttcctgtgccttcctgattgcggatggcgtgctgccgtcgaatgaaaaccgtggctacgtgctgcgtcgcatcattcgtcgcgcggtgcgtcatggcaacatgctgggcgcgaaagacaccttcttctacaaactcgtcggtccgctgatcgcggtgatgggcgcggcaggcgaagatctgcaacgccagcaggcgcaggttgagcaggtgctgaaaaccgaagaagagcagtttgcccgcacgctggagcgtggcctggcgctgctggatgaagagctgtcgaagctgaccggcgatacgctggacggtgaaaccgccttccgtctgtacgatacctacggtttcccggtggatctgaccgccgacgtgtgccgtgagcgtaatctgaaagtggacgaagcgggcttcgaagccgcaatggaagagcagcgccgtcgcgcgcgtgaatccagcggttttggcgccgattacaatgcgatgatccgcgttgacggcagtaccgaattcaaaggctacgaccaccttgagctgaccgcaaaagtcaccgcgctctttgtcgacggtaaagcggtagacgccatcacagccggtcaggatgcggtggtggtgctggatgaaacgcctttctacgccgaatccggcggtcaggtgggcgataagggcgagctgaaaggcaatggcttcacctttaccgttaccgacacgcagaaatacgctcaggcgattggtcaccagggcaaactggcgtccggcgtgctgaagctgggcgatggcgtaaaagcggaagttgacgaggctcgccgcgaacgtattcgtctgaaccactccgccacgcacctgatgcacgccgcgctgcgcgaagtgctgggtacgcatgtggcgcagaaaggttctctggttaacgacaagatcctgcgctttgacttctcgcatttcgaagcgatgaaaccgtcagagatccgtgcggttgaagatctggtaaacgcgcaaatccgccgcaacctgccgatcgaaaccaatatcatggaactggaagccgcacgcgcgaagggtgcaatggcgctgttcggtgagaaatatgatgatcgtgtgcgcgtgctgagcatgggcgatttctcaacggagctgtgcggcgggactcacgcctcacgtaccggtgacattggcctgttccgtattgtgtcggaatcgggcaccgccgctggcgtgcgtcgtatcgaagccgtcaccggcgaaggggcgattgccagcctgcatgcggaaagcgatcagctgcatgacatcgcgcagttgctgaaaggcgacagccagaacctgggcgagaaagtgcgcagcgttctggataaaacgcgtcagcttgagaaagagctgcaacacctgaaagaacaacaggcagccctggagagcgcaagcttgtccagcaaagccgaagacatcaatggcgtgaagctgctggtcagtgaactggcaggcgttgagccgaagatgctgcgtaccatggtcgacgatctgaagaatcagttaggttctactataatcgtgctggctacggtggcagagggtaaggtttctctgattgcgggtgtgtctaaggatgtgaccgaccgcgtgaaagcaggggaactggtaggaatggtagcccaacaagtggggggcaaagggggcggtcgaccggatatggcgcaagccggcggtaccgatgcgtcagcgcttcccgcagcactggccagcgttaaaacctgggtaagtgcgaagctgtaaataacgaaaaagcgcaggcaaatgccatgactcaggttgtggcatttttgtcactacgcttttgataacgataaagtcaggttgaagttgtgtatatcggctaaacttacgtttaacagaaagtaatagtggtgatagctgtcgcttcagatactggtcatcacatacttttttgacgtttatgatggataatgccgggatacagagagacccgactcttttaatctttcaaggagcaaagaatgctgattctgactcgtcgagttggtgagaccctcatgataggggatgaggtcactgtgactgttttaggcgttaagggcaaccaggtacgtattggggtcaatgctcctaaagaagtgtccgttcaccgtgaagaaatctaccagcgtatccaggctgaaaaatcccagcagtccagctattgatattatcgcgtctcgccccccggcgaggcgcggttcattcccgctattttcctcctctttcgtgacactatcatttccttttaatttccctgtgcatccgcacgtgcaaattctttggctattctgcgcttttttatcaccatggggctgaaccgcctccgccagctaccgcggccgcgcctgctaaaatctgctgataaaacatcctttttgcgctttttgcagcctaattgtctgcgaagtgtgcaatcgattcagggctgggaaaaattgtttgacttataagtcccagaaagtaatatgtgcgccacgcagcgacgatgagcagaaacaagttcttcgaagcactcgtaagaggcgtgtggtgaggtggccgagaggctgaaggcgctcccctgctaagggagtatgcggtcaaaagctgcatccggggttcgaatccccgcctcaccgccattttgcatccgtagctcagctggatagagtactcggctacgaaccgagcggtcggaggttcgaatcctcccggatgcaccattctccctcaggataacagcgaaagcggctgtcaaagagcgtgcgatgttatcgcaagcaccagggaggataacgttgctttagcaacggcccgtagggcgaggcgcagccgagtaatcctcccggatgcaccattctcctctggttgtttcagtaacaatcagcgcagtaaagcaatacctgatgcatccgtagctcagctggatagagtactcggctacgaaccgagcggtcggaggttcgaatcctcccggatgcaccatctcttttgattgtttcagtaacagtcaatgcagtaccttagtaattcccgatgcatccgtagctcagctggatagagtactcggctacgaaccgagcggtcggaggttcgaatcctcccggatgcaccattctccttcaggataacagcgaaagcggctgttaaagagcgtgcgatgttatcgcaagcaccagggaggataacgttgctttagcaacggcccgcagggcgaggcgcagccgagtaatcctcccggatgcaccattctcctctggttgtttcagtaacaatcagcgcagtacagcaattcccgatgcatccgtagctcagctggatagagtactcggctacgaaccgagcggtcggaggttcgaatcctcccggatgcaccatacttccccggtctttcagcaacagcgattcatgaaagaatctgcaatgctgttacaagcaccagggaggataacgttgcttcagcaacggcccgcagggcaaggcgcagccgagtaatcctcccggatgcaccattcttcgtacctcctcccaaatccaaaattcccgatattctccttgcgctgccagcgacaaaaatccttgtttacgttacagtatccttctgttatccggttgtgagaacgcgatgtacgaacgttacagtggactaatttttgatatggatggcaccatcctggatactgaacctacgcaccgtaaagcctgggatgacgtcctagggcgctatggtctgcgctatgatttgcaggcgatgattgcccttaatggctcaccgacctggcgtatcgcgcaatctgttatcgaatacaatcaggccgatctggatccgcatctgctggcgcaggaaaaaaccgccgccgtgaagtctatgctgctcgatggcgtgcgtccgttaccgctggtagaagtggtgaaagcgtggcacggtcgtcgcccgatgtctgtcggcaccggcagtgaaagcgccattgccgaagcgctgcttgcgcatctgggcctgcgccactatttcaccgccgtggtcgccgccgatcatgtgactcaccataaacccgctcccgatacctttttacgctgcgccgagctgatgggcgtgccgcccgccgagtgcgtggtgtttgaagacgcggatttcggccttcaggcggcacgcgcagctggcatggacgtcgtggacgtgcgcgtattgtgagtgacggcctgtcactcttctcattgtttgccggcagttttctcagcgccacgttattaccgggcaattctgaggtgctgctggtcgccttacttctttctggcgtgagtcagccctggctgctggtattaatagcaacaatgggtaatagccttggagggctgactaacgttatccttggtcgcttctttccgctgcgtaaaacgtcacgctggcaggaaaaagccacaggttttctcaatcgttatggcgcagccgcgctattattgagctggatgcctgttattggtgatttgctgtgcctgctggcgggatggatgcgcatctcgtgggggccagttctcttttttttatgccttggcaaggcgttgcgctatgttgttgtggcattcgcaacgcttcagggcatgacgtggtggcactaattgcattgctggccttaaatcgtcaaccattacaattatgctgtgtagaaatgatttcgacaggcgggaggtcaatttgatcccggacgtatcacaggcgctgtcctggctggaaaaccaccctcaggctttgaaggggatccagcgcgggctggagcgcgaaacgctgcgcgttaatgcagatggcagtctggcaacaaccggacatccggagcagctcggttcagcgctgacacataaatggatcacgaccgatttcgcggaagcgctgctggagtttattactccggtcgacggcgatattgatcatatgctgacgatcatgcgcgatgtgcatcgctataccgtgcgtcagctgggcgacgagcggttatggccgctgagtatgccctgttacatcgagaacggtcaggacattgagctggcgcagtacggcccctcaaatattggtcgcctgaagacgctttaccgtgaagggttgaaaaaccgttacggcgcgctgatgcagaccatttccggcgtgcactataacttctcgctgccgatggccttctggcaggcaaaatgcggtgaaacggataaagaagcgatctcggcagggtatttccgtctgatccgcaactactaccgtttcggctgggtgatcccgtacctgtttggcgcgtcgccggcaatttgcccgtcgttcctgcagggcaagccgacctcgctgccgttcgagaaaacggaaaacggcatgtactatctgccgtatgccacctcgctgcgcttaagcgaccttggctacaccaataagtcgcagagcaacctcggcatcacctttaacgagctgaacgagtacgtggcggcgctgaaacgggcgattaaaaccccgtctgaagaatacgcgaagctgggcctgacgaaagacggcaagcatctgcaaatcaacaccaatatcctgcagattgaaaacgagctgtacgcgcctatccgtccgaaacgcgtaacgcgcagcggcgaaacgccgtcggatgcgttactgcgcggcggcattgagtacattgaagtgcgctcgctggacatcaacccgttctcacccattggcgttgatgagcagcaggtacgcttcctcgacctgtttatggtctggtgcgcgctggcggatgcgccggagatgagcagcgacgaactgctgtgcacgcgcaccaactggaaccgcgtgatccttgaagggcgtaagcctggcctgacgctgggtatcggctgtgaaacggcacaatatccgctggcgaaagtgggcaaagatttattccaggatctgaaacgcgtcgcgcaaactctcgatggtattgacggcggtgatgcgtatgcgaaagtatgtgatgaactggtggccagctttgacgatcctgaactgactttctcggcgcgcattctgcgctcgatgattgataacgggattggcggcaccggcaaatcactggcggcgcaatatcgcgatatgctgcgtgaagaaccgctggaaattctgaaagaagaagatttcagcaaagagcacgatgcgtcatgggcgcggcagcgggaagtggaagcggcggataccgagtcgtttgaagagctgctggcaagacacgcctgacagaaaagaaaaaggccacatttctgtggccaaatattcatctctgaaaacagggatgatgataacaaatgcgcgtctttcatatattcagactcgcggttgttcgaagagttcagtttatttttaaaaaaatcactccggaggtgacaagatgccattgttggatagcttcacagtcgatcatacccgtatggaagcgcctgctgtgcgcgttgccaagaccatgaacacgccgcatggcgacaccattaccgttttcgatctgcgtttctgcattccgaaccaggaagtgatgccggaaaagggcattcatacgctcgagcacctgttcgccggtttcatgcgcgatcatctgaacggcaacggcgttgagatcatcgacatttccccgatgggctgccgcaccggtttctatatgagcctgatcggtacgccggacgagcagcgtgtggcggatgcctggaaagcggcgatggcggacgtgctgaaggtgaaagagcagaaccagatcccggaactgaacgtctaccagtgtggcacctatcagatgcactcgctggacgaagcgcaggagatcgcgcgtcatattctggatcgcgacgtgcgtgtgaacagcaacgacgaactggcgctgccgaaagaaaaactgcaggaactgcacatctagtttcggtcagtgaggtataaaaaaagccagttcagtgaactggcttttttatttgccggttttgccgggtggcgcttcgcttacccggcctacacctacaaagcgtaggcccggcaagcaacgcgccgccgggcaaaacgacacaatatcaatgcgcgccgccaccaccacccgcgccgaacggcggtctggcgaaccacaccagccccagcagcagaaggaagatcccggcggagatccagaaaatctcattggccgaaatgatcagcccctgattggtgatctgctgggcgatccacccggacgcctgctgctgcgacatgcccattccctcaagctgcccgtagatttgctcagtattcgcgttataaggattcaccgactcggtcagctgcgcatgatgcatcgactcacggctggtccatagcgtcgtggtaatcgacgtaccaatcgagcctgccagcgtgcgcgtaaagttcgacagactcgacgccgccgccagtcgttcaggcggcagaccggagagcgtaatggtcgtcagcggcataaagaagcaggcgacggcgaagccctgaataaactgcggccacgcggacgcgccaaagtccatgcccggctcaaaggtataggcgcgccagtagaagcacaccgcatacataatgaagctgaaggtcaccagacgacgcatatccagcttatgagcaaagcggccgataatcggcgacaggatcaccgggataatgccgaccggcgcggacgccagccccgcccaggttgccgtgtagccgtatacctcctgcaacagctgcggcagcaacacaatagcgccgaagtagagcatataggcaaggctgatacacaaacagccgatggtaaagttgcgcgacttgaacagcgaaagatcgacaatcggatggtcatccgtcagctcccagacaatcaggaaggagagggagaccaccgcaaccaccgtcagcacgataatttcggtggagttgaaccagtccagctctttaccctgatcgagcatcacctgcaaactgccgatgccgacgatcagcaatgccagcccgacgccgtcaatgcgccgctgctcggtacgggtttcgcgtccgcgcagcgcctgcgccgccatcagcaccaccaccagaccaataggcacgttgatgaagaagatccagccccagtgatagttatcgctgatatagccgccgaggatcggcccgcaaatcggtgcgacaatcaccgtcatcgaccagagcgccagcgccaccgaacgtttggcgggcgggtagttgctcagtaacagactctgcgacagcgggataaggggacctgcgacaataccctggatcacgcggaagaaaatcagcatgttcaggctgctcgacaccccgcacgcccaggaggcgatggcaaaggcgacggtggaccataaaaagagtcgcacctcgccgacgcgtttcgccagccagccggtgatcgggatggagatggcattcgccacgccaaacgaggtgatgacccaggtgccctggctcagtgacgcgcccaggttaccggcgatggtcgggatcgccacgttcgcaatggtggagtccagcacctgcatgaaggtcgcaagggacagcgcaatggtcatgatgaccagctgcgcgccctccagcggtttacgctgctgcatagcactcacctcaggattaacccgcgttggcctgaacgatgttattgatcagggtattcaccggctccaggctgatttcccgcgcattactttcatacgctggcgtactgcgcgcctggcttgccagcacctggccgtcgcggttggtggtatccaccgtcaccagcgaagaaagaccaatgcgcagcgggtgatcggcgagctgtttcgcatccagctcaatacgtaccggcagacgctgaaccactttgatccagttgccggtggcgttttgcgcgggcagcagcgagaaggcgctgccggtgcccatatccagaccgaccactttaccggtgtacttcacctcatcgccgtagaaatcgctgatcaccgtcgccgtctggccaatacgcatatgcgccagctgcgtctctttaaagttcgcgtccacccacagaccggttgccggtaccacagccatcagcgcggtggtcgggctgatttgcgcgccaggctgcacggcacggcgggaaacatagccggaaatcgggctgacgattttggtacgttgcagcgcaagccaggcgttacgcacttcagtggcggcctgttgcaccgccggctgatcttcaaggcgggtgccgaggatcatcgcctggttggcgttatattgctgcaccgccacatcaagctgcgcctgcgcgctggcgaccgcatcacgggagtgttgcagctcttcacggccaatcaggttggcgctgcccagcggtacacgacgattcaaatcgctctgcgcctgggcgagggcggtttttttcacttcgatgttagcctgatactgacggctgttgatcatcagctggcgggtctgacgcacgctggaagccagctgcgtctgcgctttttcaaatgcctgctgggcatccgtcggatcaagggtgaccagcacgtcgccctgtttcacataatcggtgttgtcatgccagactttcgtcacgctccccgacacctgcgccataatctgcacctggttgccagccacatacgcatcgtcggtttcttcgacgtgacgcagtaccatgaaccagtaaatcccgtatgccacagcaataataataaagagcaaggtcagaagaagcagggcacctttacgtttgcctttcttcctgaccggttgctgcggggtttgagtctccgcatttgcgctcatgtgtgttctccacgatctttttatatattcggcaacgccgacctgttcaccaaaaagccagcattaaaaatgctggcctggcggatttcttatttaatcaggatgtcagagctaatcgtcgcgttagcgcagcgcctcaagaatgacgtcttcttcgtccatctggtcgaggcggttcagtagcttacgggtgatttgctcaagctgttctttctcggcggggctcagagaagaccagagcaggtgcagacagttatgctgcgggggtaaaacctgacgcaaaaattcgtgacctttttcggtcaattgcagatgcagacaacgacggtcgttgtcgctctcacggcgttcgatccagccgcgtttttccagttcatcggcaatacgggtggcattggtgcgcgacgaacccagcgcacagctcagctcggaaggctgaatgctatgattttcctgcgactcaagggtaattaacgccatgaacaacgtttcgttgatcccctgcgctttcagcattttgttgcggttatccagcagtttgccctgcatatgcatacacaaacgcgtcagcagaatttcctgaaacggaaaatcttcataacgactggcacggaacttcagcatttgctcaatgggcgtgaacgaactttccatctcaatatgacctcattaattacagccgatatagtaacggcggtgacaaataatgtaaatgtattattttccttgagtgattagttttaagaatagtttcagccgggctgaagccgatcctggcgatggtagccgagccaccagaccagcagattcaacagcgccatcacgctgcctgccacacagacgcccgcccagcccgcatgctgccaggctgatgcagaaatcagcgagcctgccgcgccgccgataaagtagctggtcatatagcccgccgtcagacggttacgcgcgtccggcttcaccagatagatcactgtctggttggtgatatgcacgccctgcacggtcagatccagcaccaggataccgatgatcaacgcaatggcagaagtatgaccaaaccagatcgccacccaggagagcagcagcaacagtaaaccggtggtggtggtgatatgcgccttgcctttatccgccatgccgccggcaggccgcgcgcccagcgcgcccgccgccccggccaggccaaacaaaccgatcacgccttcggagtaattaaacggcggcgcggccagcagaaacgccattgaggtccagagaatgctgaaattggcgaaggtcagacagccgagcaccgcgcgggtacgcagcagcgaatcgcgggtgaacagagaaaatatcgagccgagaagctgaaagtagttgagatgattatcctgcttcactttcggcagcccgcgccacagcgccagcgccatgaccagcattaacgcgctcgccgcccagtagacggtgcgccagccgccaactcccgccagcaggccggaaacggtacgcgccagcagaatgcccagcagcaacccgctcatgatagtgccgaccactttgccgcgcttttccggcgaggcgagggtggcggccagcggcaccaggatctgcgccaccaccgagaacagcccggtcagcgctgtgccgaagatcatcatccacgccgaatggctggtggcggtgatcagcaggccgcaggtggagagcagcgtcatcagcacaatcagcgtccggcgttcaaacatatcgccgagcggcaccagaaacatcaggccgaccgcatagccgagctgcgcggcggtgacgataaatccggcctggttgggggtgagggaaaaggcgcgggcgatggtatcaagcagcggttgcgcatagtagttgctggcgacggcgagaccggtcgcgacggacatcagcacgatcagagccgggctgagggtgtgggtggaatttttcattattattgaagtcgttagttgagtggttttcttgccagaattcaatgataacgaattgggggattgttggggaattgttacgtgtccgaacgtgcggttaaagatgcccctctcacagcaggagaggggtacctgaatattacttctgcgctgccagcgcttctttcacccagccgtcaaactgctgctggtgggctttgatccagccatcgacatgaccgttaatatcggcttctgaggctttaccggcatgcatcatcgcgttctgcgcgttaatgtcagccagcggcagtttcatcaccgagaacagcttcgccgccgccgggtttttttccgcccaggctttgttcgccacaatgtgcatcgtgttaaccgggaagccgtagttcatgccgttcggcagtttagtatcaatatttttctgctcgcccggcagggaggagaacggcacctgcaaccacaccacgtctttacccggtttcagcacgtcgctcacccagtacggcgtccaggtgtaatagagcaccggcttaccttctttaaagcgtgcaatggtatccgccatcatcgccgagtagttaccgtggttcacggtcacggtatccgccagcttataggcctcgttctggtggttgatcaccgcctcgcagccccagcctggcgtgcagcccatcatgtcggctttaccgtcgccattgctgtcgaacagcttcgcgatcttcggatctttcagctgttcaatattggtgatgtgatatttttcagcggtttttttgtcgatcagataaccctgggccgcgccggtaacaaacaccccttcgcggtaaaacttcttatcgccgcccgctgcggcatacatatcgtcatgcagcggctgccagttaacggcggtaaaggtggcatcaccggaggcaatggaggtatagccaacgttgtaatccacttcgctcggcttattcacggtgtagccgagcttttccagcgcgcggctgaccagctgcgtctggaagctttcttcggagatggtgctctggatcggttgtacggtaatgcctttacccggcagatcggcggcgaaagcgctggtggagataaggctggcaaacgctgtggcaatgattacattctgtcgcatcgttgttcctcaagctaaacattagtcaggcccggcaggcgtagcgccgccgggcaacaggatcacttactgaacggacgggtcagcagacccagcgggccggtctgataccagcggcggttgccacgactgcgggagtcgcgacccacggcctgggtcagacggtcaagaataatggcgaggatgacgatcccgacgccgccgacggtggccaggcccatatcaagacgaccgataccgcgcagcaccatctgacccaacccgccaacggcgatcatcgaggcgatcaccaccatggaaagggccagcatcagcgtctggttcacgcccgccataatggtgggcatcgccagcggtagctgaactttgaacagcatctgccgcgggctggcgccgaaagagcgcgaagcttcgatcagatccgccggtacctggttaatgccgaggattgtcagacgcacaatcggcggcagggcgaagataatggtcaccaccacgccgggcacgttaccgataccgaacagcatgacgataggcaccagatacacgaacgccggtgtggtctgcatggcgtccagcagcgggcgaatgatcttcgccgcccgctgactgcgcgccagccagatccccagcggcaggccgatgatcatgcagaacagcagcgcggtcagcaccagcgccagggtgatcatcgcctgcgaccaggcgccgatagcgccgatggcaactaatgaaatcagcgtcgccacgcccatgctgaggctcgacatctgccaggcgatcagcgcgaaaataacaatcgccaccggcgcaggcatacccagcagcaattgctggaaggcgctgaggatataatccaccggcacgcgaatgccctggaacagcgggcggaaatgcaccaccacccagtcgataccctgcgtcacccagctgtcgagtgggatcagcgacttatggaagggatccataatattgaaatgctccggcgcaggcggcgcgctggaaagccagtctgtaccgccgccatcggctggcgcccctgacgggctgccccatgcatctgcggactgtgcggcgctgtcggcagccggttcgctgccccacggattagattgatcagccattgttcaccccatcgcgatctaaagccctgagcagcgcacctttggagatgctgcccatatactgttgctcctcacccactaccggtacggcgcagggcgcctgtccgacaagggagagcagttcgctgagcggcgtttcggcttccaccgcagcgggggactccagtaacgccgcatcgatacccagattctggctcagcgccgttttcagggaatcaacagagacaatgccgacaaatttatttccgcgctcgatgacgtaaccgtaatcacgatcttcatcctgcaataatttcagcgccgagcgcgggccgaaaccaggcgttttacggatcagacccgcctgagtacgacgggcaatatctttggcgctgaacacctgactaatatccacgccgcggaagaaggtgcggacataatcattggccggattattgagaatttcatcgggcgtaccgacctgcaccactttgccattttgcataatggcaatgcgatcgccgatacgcatggcttcatccagatcgtgggaaataaagacaatggtacgctgatgtttcgcctgtaattttaccagctcatcctgcatttccgtgcggataagcggatcgagcgctgagaaggcctcgtccattaataaaatatcaggattaatggctaatgcgcgcgccagaccgacacgctgacgcataccgccagagagttcatccggatacgaatgggcataattttccagccccacctgacgcaacgcgtccagcgctttggtctggcgttcagcggcgggcacgcccgctaattccataccgaaggcggtattatccagtaccgtcatatgcggcatcagcgcaaatgactggaagaccatcgcgatctttttcctgcgcacctcgcggagtgcggcgtctgatattttggcgatgtcttcgccgtcaatcagcacctgcccgcgggtgggttcaatcaggcgattgagaaggcgaaccatggtcgatttacctgaaccagataatcccatgatgacgaaaatctcgccttcttcaatggccagactggcgtcaatgacgccaagcgatagccctgttttttccagtatctgttctttcgaaaatcctttttcgatatatttgaaagctcgctgtggatgctcaccaaatattttatagagatttttaatttcgagtttaattgccatgcaataaatgagttcccgttatttatttatatcaatacagttcctgatggaaataatgagcgggctataccctaacatactcagattctgtgacaaccctcaaatgccagctggcacggaaattgccgaagcgcatctggcggcatttcccatgatataagggctgagagcgagtcttacaaagtgatattttttttgaaaagcacgtgaaatggtacctgaaacgggaagcttcaggtgaaaggaattagttgggagcagtgtagttcacagggaaatattcgtgtgatgaaaacggaaatattatgaaatatccatccgggaaatacggaaatatttcccggagaggagaggattaaaaatcccagtcttcgtcggtggtttccaccgctttacccatcacataagacgagcctgaaccggagaaaaagtcatggttttcatcgccgttgggcgacagcgccgcaaggatcgccggattcacatcagccatttccggcgggaacaatgcttcatagccgaggttcatcagcgccttgttagcgttgtaacaaagaaaagcctgcacatccgcttcaaggccggtgccgccgtataaatccgcggtataggccagctcgttgtcgtagagatccatcagcagatccagcgcaaaaagctttaacgactcgcgctctgtttcgtcgactttttcgaggcccttctggtatttataaccgatgtaataaccgtgtaccgcttcgtcacggataatcagccggataagatcggcggtattggtcagcttgccgcggctggaaaaatacatcggcagccagaagccggaataaaacaggaaggattccagaaagacgctggcgattttcttcttcagcggcgcatcggcggcgtactgctcgaggatcagctgtgctttgcgttgcagcggcgcgttttcctcgctccaggcataggcggcatcgacatctttggtctgacacagcgtcgagaaaatcgagctgtaagagcgggcatgtaccgcctccataaagctgacgttcgacaacaccgcctcttcatggggcgtcagcgcatccgccatcagcgccggcgcgcccacggtattctggatggtatcgagcagcgtcaggccggtaaacacgcggatggtaagctgctgctcggcctggttcagcgtctgccaggcgggaatgtcgttagacaacggcactttctccggcagccagaaattgctggtcaggcggttccacacttccagatctttatcgtcctggatcttgttccagttaaccgcactgacgcgggataaacggctcatccttttctccttacagcgcgcatgacacgcagccttcaatttcggtgccttccagcgccagctggcgcaggcggatgtaatacagcgtcttgatgcctttcttccacgcataaatctgtgcgcgattgatgtcgcgcgtggtggcggtatccgggaagaacagcgtcagcgacagcccctgatcgacatggcgcgtggcggcggcgtaggtatcaataattttttccggcccgatctcgtaggcatcctgatacatcgccagattgtcattggtcataaagggggcagggtagtacacgcgcccggttttaccctctttgcggatctcgattttcgacacaatcgggtgaatgctggaggtggcatggttgatataggagatcgatccggtcggcggcaccgcctgcaaattttgattgtagataccgtggcgcatcacatcgtcgcgcaactgctgccacatggcgcgcgtcggcagcacaatgcccgcgcgggcaaagagtgtgcgcactttttcggttttcggctgccactcttcttccagatagggcgtgaagtattcgccgctggcgtagcgggagcgctcaaatccggcaaaacgctggccacgctcgcgggcgatcatcattgaggtatgcagcgcgtgccaggtgatggtgtaaaaatagagattggtgaaatcaatgccttcttcgctgccatagagtatgccttcccgcgccagataaccgtgcaggttcatctgcccgaggccgatggcgtgggatgcggcattgccgttttcaatggatggcaccgagcggatatggctcatgtccgacaccgccgtcagaccgcgcaccgccgtttccaccgtgcggccaaaatcaggggagtccatggtatgggcgatgttaagcgagcccagattgcaggagatatcccgcccggtctgcgcgtaatccaggttttcatcgtattccgacgcgctgttgacctgcaaaatctccgagcacagattgctcatgttgatgcgcccggcaatcgggttggcgcggttaaccgtgtcttcatacatgatgtacgggtaaccggactcgaattggatctccgccagcagctggaaaaaatcgcgcgcgttgatgtacgttttacgaatacgatcgtcggccaccatctcatggtagtgctcgctgatcgccacatccccgaacggcttgccgtaaatacgcgctacgtcatagggagaaaacagcgccatctgcgcattgtctttcgccagctggaaggtgatatccgggatcaccacgcctagggaaagggttttaatacgaattttttcgtcggcgttttcccgtttggtatccagaaaacgcagaatatccgggtgatgggcgtgcagatagaccgcccccgcgccctggcgcgcgccaagctgattggcataagagaacgcatcttccagcattttcatcaccggaataacgccggaggactggttttcaatgcgcttaatgggcgcgcctgcttcccgcaggttagagagcaaaaacgccacgccgccgccgcgtttggagagctggagcgcggaattcaccgcccggccaatcgactccatattgtcttcgatacgcagcaggaagcaggagaccagctcaccgcgctgcattttgccgcagttgagaaaagtcggcgttgcgggctggaagcgtccggcgaggatctcctgcgtcaactgctgcgcgagttgctcatcaccctgcgccagcgtcagcgccaccatcaccacccgatcctcaaagtgttccagatagcgtttgccgtcgaaggttttcagcgtgtagctggtgtaatacttccaggcgccaaggaaagtctggaaacgaaaaccgctggcgtgcgccgtctcaaacaggccgatcacgaaggcgcgatcgtagcgcgccagtacgctgtcatcgtaatagccctctgcaaccagataatccaggcggctgttctgatccgcaaaggtcacagtgttaggcagcacgtgggcggtatagaacgcgtccaccgcctgatgatctttttcaaactggatgcggcccgctttatcgtacagattcagcatggcgttcagcgcgtgatagtccgtggaggcctgcattacgcgttctgcggttgtcgttgccaaaattcgctcactccttttcgcacatttatgatgtcacgcggcgtacccatcagctcaaaacggtacagatgcggcacgctgcatttttgcgcgatgacatcccccgcacggccataagcctcgccaaaattgcggttaccggcggcgatcacgccgcggatcaaggcccggttatgcgcatcgtttaaaaagcggatcacctgacgcggcaccgcgcctgcggttccgccgccgccgtagctcggcaccaccaggatatagggctcgtctacctggatccgctcacgctcatccaggggaatacgcacagcgggcagtcccaggcgggtgataaagcggtgcgtattctccgagctgctggagaagtagacgagggtgctcatgcgctggcgacgcggggggcgctgcccagacggttaatcatatcggggcgaaagccggaccagcgggtgtcaccggcgatcactaccggcaactggcggaatcccagcgcgcgcagttcatctgccgcctccggcaccaggtccacattcaccaaatcgaacgccacgccacggctttccatggcgcgttttgtcgcatggcactgcacacagtcatttcgagtgtaaatagtaatgcgcatgattcgtatttccatctaagatagcgggacgacgcgaaaaatcgcgccgggttgtgtgtcacttgcttaaggaaatactagatgtagttataaagattatcaaccacacaatatccaggaatttttagatcaatttcatcccgctgaagaactcagcggggaagggatttttgtcgctaaattacatgcgcatagcgatggcgagacggttaaaggcattcatcaggctgatggcgaaggtcagatcgctgatttcctgagcgctaaaatgttccagcatgggctgataaacatcatcccccgcatgggtcgtggagatgtgcgtcagcgactccgcccagcccagcgcggctttttccttcgcgctgaaatgcgggctgatatgccagcctgccagtgcatcaagtttgctctggtcggtgccggttttacgcagcgctttgctgtgcatctccagacaaaacgcgcagccgttgatctgcgacacacgtaaataaaccagctccagcagcggtttgtcggtagcgctgcgctccagtgcctggctggtctgaatgaggccgttatatgcctccgggctgagttcggaatagggcaggcgtaaatcagtcatggtcatctcctcgtttagatggcgagaaggtagcactataatggtctgcaccagagagccatattttaactaaaaaagcagaccataatggacgcccgataccagcaaattgcccgtcttctgaaatcttccatcgcttccggcgagcttgctcccggcgcccggctaccgtcgagccgtaccttcgcccgggaaaacggcgtgtcgcgcgccaccgtagagcacgcttatgccgagctggtggcgcagggctggattgagcggcgcgggcaggcgggaagttttgtcagcgacaccgtgacgccgggcagcgctttacccgcggcgtccctgacggaggggacagataacattccgcagccgtttcagatggggttgcccgcactcgatctctttccgcgcgcgctctgggggcgactgatggggcggcggctgcgcacccagacgcgctttgatctggggccgggcgacgtggcgggagagcggctgttacgccaggctatcgtcgattacctgcgtttttcccgcagtattgactgtacccccgggcagatatttatcaccgccagctacgcgatgtcgatgacgctgatcctgcgcacgctcgccgctgccggcgacggcatgtgggtggaagatccgggctttcggctgatccgcccggtgatcgcccgtgagcaggtcaggctgttgccggtgccggtcgatgagaacggcatgaatatcgacgccgcccgggcattacatccgcaggcgcgtttcgtgttgctgacgccagcgcatcagagcccgctcggcgtggcgctctcgttgccgcgccgtcggcagttgctggactgggcggcgcaccgtgaggcgtggatcatcgaagacgattatgacagtgagtttcgctatcacggcaaaccgctgccgccgctgaaaagcctcgacgccccgcagcgggtgatctacgccgggaccttcagtaaatcgctgtttccggcgatccgtaccggctggatcgtggtgcctgcgccgcacgtagccgctttccgtcgccaggcggcgatgtatccctgtacggtgccagggctggttcaactgacgctggcggattttatctcgcagggtcatttctggcggcacctgaaaaacatgcgtcagcattatgcccggcggcgtgaatggctggaaagggcgcttaagcagcagggttttgacgtggcggcgcagcagggcggcattcagctggtgatcgcggttacggatgacgataagcaactggcggcacgggcaaatcaggccgggctggcggtgcaggcattaagcgcatggcagatagcggggggcgacagaagggggcttctgctctgttttactaatatttcatcggcggaaatggcggaacagctggcggaaaaactcagcaaggcaatacgccccgcgagcgcaactcacggggcagcaatggactagcgacgcatgctcaggagcgcgccgaggaaaatcccgaccgctgccgcagcacctacgctggaccatggtttttctttaacgaacgtatccgcgcaacccactacatcgcaggctgcctgtttcacacgggtacggccctgcagttttgcacgggtttcttttaacagcgcctgtgctttacgacgtgcgccatcggcatcatccttcacgtcactgccccaggacttaagtacgctttccaggctgtccgctaaacggctgacatcatcattgatatcctgaacgccttgatcaacatctctgcggttcggtctgctaaacatatgatcctcccttgttttcgttgtcatgatcagtgtagcgcacaaaatccacccttgaagcggatcgcgagatatgccgccctttatggacttttccgaaagcgctgctaatgctcattactgtaaggttgcgatgcagtaaatgatgacgaggaaaaaatatgtatttacgacccgatgaggtggcacgcgttcttgagaaagcgggatttacgatggatgtcgctacgaataaaacctacggttaccgtcgcggcgataattatgtgtacgtaaatcgcgaagcgcgaatgggacgtaccgccttaattattcatcccacgcttaaagagcgcagtttgtcccttgcggagcccgcctcggagatcaaaatgtgcgatcactatcagcatttcccgctctacctgggcggcgatgcgcaggagcattacggcattccccacggattcagttcgcggatggcgctggagcgttttctgtcagggctgtttggcgaatcggcataatgcgttttcttttcatgcttccaataaggtgaagactcaggaaaacacgaacctttaagataatgcagtgaccactatcgcaattgatcgttaacgctggtggtcagctttgtctcaccctcatagaaaaaatcgtggagattgtaccgctttcgatgccataaataacatcgggggaaagtgtttactatacctatgagaccagaatgtgcggtgttaaggaaactattaccgacatggctttcaacgtcgctggcgttcgagatatcgcaagggtgctgaaaatcagcatcattatcattacgtatcacgtattcaaataaagtgtctaaccagtaaaataatctgtatgtcctgctctgtgtacctctttgaaaacatcaagggtgccttcactcaaaaaaatagatgttccactaattgaaggtcttacaaatttgtaccggagcaaactacacttcggtgtttttttgtttcattcctgttaatagtggggcctgtgtgcagagattttagcgttggatgagtatttgccgctcgttctattgagtcattcattggttacttccaaaattaacccccttctttattaaatgtgattttaagcaagtttcgaaacgctgttaagcgtattttattgtttgatttatatttaaatatattcacgagatgaatgcaaaagggaatttatatttatgacagttaaatttcaccctctaaacttttctcctgtagcgttcccgcatatacaaaggaacggcttgcgcgtcatgcgtgcaggagaaatacatttagcccagcaattatatggccatagcatccattatgaaaaagtctggatccaccacggcagttttttgccttttgatatgcaggaaaaccacacggcaatgacgccgaccggggagatatggtttgaacaagagctttataaggatgatttttctagatcagatttatctttaaaacatatttttatgcatgagcttatgcatgtatggcaaaaagagcgaggtatgaatgttattatgcgaggtctgatttcaggtataactgactatcactacaagctagataaataccgtctttctgattactcaatggaacagcaagccagtattgtatctgattactggcttttaaagcacttcggattttctcgtaaatcagctcataatttacttgattacaatcctaaaatccctgcatgtaaactcttatctgaatacgaaagaataatgggaaggtttccaaattgaaaagtttattgctgctattttctttcatgctttcagcatgttgctgggagcatcaaattgccctgcatcccggtgatgcctctatcaatagaagttctatttgtatatcttcatcgggtgggaaaaacctttcaggatatgctttagacgcaagaacacttgataatcattatgccgagagagatttggtggtttcagaaacagtaaatgcacgaacgccatactgttttaaattaaatcttgattcctatatggagtatacgctttactacgaattagatgatgttaattacacggttccatttattactgatgattctcctgtcgtgtacacaaaggcctactccaattaataaggaaattaattatgtcattacccgcttatatgtttctgtacgacgaaaatggtgttttgatgcaggggacttgtgaagcacatggacgcgtcggggctaccgaagtttcaacttcacaatttggcgtttatcaggggatggataatttcactgggcgttttagtggttcacgtcagcatgaaccttttacattccgtaaagagatcgacaaattaactccgtttttgttcattgcagtttgccaaagcaaacgttttaaaaaagttgagtttaaatactatgaaacatcttcagccggtatagaggttgaaacattcaatgtaattatggatgaggtgggcatcagttcctataatttcggtcatgcttatgcccccggcgctattcagtcgaatatgagtgaaatcatagggttccgctcaacaaaaataacagtgcgttatttacctggtaacatttcatattcagactcctggtatagggaatagcaatatttatttactgatgttttccccggtttcttattgaatgtaaatgtagcgacgggcctgtgcctgtcgcctgccgtcaggctttcgcctggtagtaattactcactctgaacagacggcggcagtaatccaggaagtagccgtagaccgcgcccattagcatcgataccacgatattcgaacttaccgccgcggcgatctggtgccagtctgcacccaccgtcagcaaaatcgccacgtagaccggtgactgaaaggtgacataggccgcgatatccgccagatttttcatccagcccgccggggtataacgacgcgccatacgcataatcgcatcacggtacaggccgtagggccaggcaatcaggatgttaaccgggatggcgaccagtctggacgagagcgactgctcaaagctcatgcctgaaagaaatatctcaatcagcatgttcactaccgaacagtagaccaccatggcaaaggtgtcggccacggcgtgacgcaggcgtgactgcggagagaacatgctaaagctcctgtgaaatatattatcaggtcgttcgccggtgaaaccagcgtaatgaagggggatgtttagtgtggatagagtatatcgctaccatgaaacgcacaattagcgattaatttttatttaacgcgcttttgtcaataaaatactctgtgagcgggcgattttttcgcgctgcgttatattgcgcgggaggtcagaggaaagtgttgataaacaatgagttgaggagaatgcggtgagcgcgcccaccgcacatgcaaaagacgctgattaacagacgccgaaatcgccttcttctttatatggcgtgacgtcaaccgctttcagggtaaacttttcaccctgttcgtcgctggcgcgtacggcaacgatttgatcgtcatttacttcgatcactttcagttttgggccgcccatacgcggctgcaccagatcacctgctgaaaacataattgcactccttcatgaatagtatgactgcgtaaagcagagtaaaagcataagacgaaactggcgatacccgccacaatgactacgcttaaagagaaattgtctttttttacaataacctggattttgcttgcaagggagtagttatgggtttctggcgtattgttattaccatcatcctgccgccgcttggcgtgttactcgggaaaggcttaggcggagcctttattctgaatattatcctgacgctgctgggttatatccccggtctcattcatgcgttctgggtgcagtcgcgcaactaatctttccggcggacagggcctcctgcccgccactcctgcttaacgcttaaaaggtttcccagttcgcatcacctgcggcggcggttgccactgccgggcgtagcgtggttttcgctttcactacgggtgttaccgggcgacgcagtttgtcattcacctgaaagaccgccaccgcctgacgcagttgatccgcctgttcttccagtgccgccgctgcggtcgcggattcctgcaccagcgcggcgttctgctgcgtgacgctgtccatctgcgataccgcgaggctcacctgctcaataccgcgactctgttcatccgacgccgaggcgatctcgcccataatatcggtcacccgcgtaacggcattaacgatctctttcatggtttcacccgcttcggccacctgtgacgaaccggtatccacgcggctgacggatttttcgatcagcgccttgatctctttggcggcgctggcgctgcggctggccagcgtacggacttcacccgccaccaccgcaaatccgcgaccctgttcaccggcgcgcgccgcttctaccgccgcgttaagcgcaaggatattggtctggaaagcaataccgtcgatcacgctggtgatttgcacgatctgctgtgaactgtcggcaatatcgttcatggtgcgcaccacattggtgaccacctggccgccgcgatcggccgtttccgaggccgtccgggccagttgagcagcctgacgggcgttatcggtgttctgtttcaccgtggcggtcagctgctccatgctggcagcggtttcttccagcgacgccgcctgctgctcggtgcgcgaggacagatcattattaccggaggagatctctcccgcgccggtgtagatggaatccgagctgctgcgcaccgcgctgacggtggagaccagcgactgttgcatctcatgcaggcccgcagctaactggctcatttcgttacgcccgtcagcatcgatctggcgcgtcagatcgcccccggcaatggcgcgaatatgcgccagcatgtcctgcaaaggtttaagcaacatgtgttgcagacccagccagatcaccacaaagaccgcgagcatcaccagcaaaatggtgcccagcgtccactgcatctgggtaaaactgtgctgattctgcgcggctgcggctttcagcagaccattgttttccgcacgccactgggcaaacgcggcttccatttcatcctgcgcctgctgtgcatcaagattgccgtaggcttcataattattggctttcagatactggatcgacatctgcaacacatcgtgcatctgacgccagtttttctccatcagcgcggcgaccgccgcatcctgcccgctgatacgttcagtacgcttgtagctttcgaagtaaccttcagatttgctgagtgaatcgcccgccgtagtcagcagtttatcgatggccgccagcgaggccggatcgcgctgatttttcagaaaacggatcgcaacgcgggtcaaagtgacgcgggttttgacaagggtattcacactgtcgctaagattttcctgctgtgcgttcagtacgccatattgttgaaagttgctgcgatcattatcaaccgcagaatagaacaacccacccgtcaccacctgcaacatacagaaaatggcaagcgcgaagatgatcccggtgatgaccttaatatttttaagcatgacagccgtccgtaagtgatccgcaagtgcataagggttatcgacgacggcagggggatctttatgaacatttagttaacatgtgcataaaaattagccccggtggttataaccggggcgggggattattgaccggccttgcgcagctcaaccgcgcgggcgatagacggctccagcagacgggcgacggcggcgaacaccggcacgaccacggaattgccaaactgacgataggcctgggtgtcggataccggaatgcggaacgggcgtccgccgggggtttcaaagcccatcagtcgcgcgcattccaccggcgtcagtcgacgggggcggcgcgcctgattcgttggatcggcaaacgccgtttcgcccagcgcatgatcccagccgcgatcgacaaggatctccgagccatctttgtggtagcgggcagacaaagtacgcgtcaccacgtccgggcgcgtgggatccaccagcccgaagccaaaaccgttgcccttcgcctggtgctttttggcgtagcggtagagaaaatcccacagcttttccgacagcacatacttgctgtcgaccaccggatccagcagctcgccgaaggccggtcgctgcgccggataaaagcgtttgatatcgcgcagggtaaaattgttgtggatgttcaggtcgcggcggaatcccaccagcactatgcgctcgcggtgctggggtaaaaaatgtttgccgtcgatgattttcggatcgtccttgccgttcaccgccgcatcagcgacctcgtagcccagctcgtccagcgtctgcatgatcacgctgaaggttttgcccttgtcgtggcttttaaggtttttaacgttttcgagaacaaaaatcgccggttgtttggctttgatgatgcgcgccacgtcaaagaacagcgtgccctgcgcttcacattcaaaaccatgggcgcggcccagcgcattcttcttgctgacgcccgcgaggctgaaaggctggcaggggaagccggcgagcagcacatcatgatcgggaatggtgcggtcaatgtgcgcgtaggcctgcgcctcggtgacatccgggttatcgcttaaggtgacttcccggatgtcgctgttaaaggtatgcaccgcgtcgtcgttataccagttggctttataggtacgcaccgcgttcttgttccactcgctggtgaacacgcactgaccgccgatggcgtcaaaaccctgtctgatgccgccgataccggcaaataaatcgataaaacgaaacgcatagtcgggatgatgggcgggcggagagggcagcattttgcgcaataatgcttcttcgctggcggtgagggatttcggcgcgcacttgccgttcacccggcggttaagggtttcccggctccagtcgtttttgcccagcttgcgcagctgctcggccacatatttttgtccgtagatcgccagtaccttatccagcagcgctctgtcacgcgcctgttgatcctgctcttccgcctgcgccttcgccagcagatcctgagcaataacatcaaattccgacatagcatctccttggtttaatgtgtgaaaatatatcactcatttgacccagcgccttatttcatttgcgcagcactgctttttttgtcattgctatactctgatttcacccctctggtggccttaagggtactttgtgcgtattgcaactattaccaatgtcgcctacgtcgcgacggttattctgacgctcgcctccggcgtggcgctgtttatggcctccagcgccgatcgcacggagcgcaaagccgttgaacagcgctatgtgctggataaacttaccgaagagattgaaatcgaagccttcgccttaagcgaactggcgcgctcgatcgtcattaatcctgatgctgaggagatccagcagctgaaagccggattcgcgaaagagcgggagctggaaaaacatctggtcgccgtgaaagatgtcggcgcctcgccggatgagctgctgctgttacgggacgggatggtggtgctcaaagcgctggaggatgagcagcaggcggcgctggcagcagtggaacggggcgcggcggcggaagggatgaaaattgtcttcagcgccgattacgagcagcagctcgatcaggtgcggtatcgcttcgatcacttccggcagctgctggatcagcgggcgcaggtcgcgatcggcgaggcgaccaaaaaatcccagtggctgcgctcattatcagaaatcatggtcggcctcaccgcgctgctgtttctgtttgtgctgggctttattatcaagcaccgcattctgcgcccggtggtgacgctcagcgatgtggttaaccgtctcgcctctcaggattacgacgtcgaagcgccggtgctggcgcaggtggatgagatcggcgacatggcgcaggcaatccgcatcttccgtgagaacggcctggtccgccagcggctggagcgcgagcgcgatgccgactgggtgacgcgcaatctgctggcccgcatgacgcaacggctacagggctgcgactccagggacagcattctgaaggtgatcgccctgtttgtgccgcaaattatcccggatatgagcgggcggctgtatatgctcgatcggcgcgccaaccgtatggtgtgcatgaccagctggctgtcgccctccggtgacgacacgccctttaccccggatcactgctgggcgctcaaacgcgggcagcttcacagcccggcgcgggatacggtggatgtgccctgcgagcatttaacgcccgacgtcgctgacaaggcgatctgcgtgccgttaatcgcgcaaaacaatattatcggtctgctgaccttcgagaatcgtgcgccggagaaagagccgccttacacctatcttgaactgatcgccgaaaccctggccctgtcgctggctaaccagaagctgcgcgatacgctgaccgagcgggcgatgtacgactccctcaccgggctgcacaatcgttatcatctggaagaaaccctgcgaacgctgctggggcgcgccgaagcgaagaaaagcgtgctcagctgtctgatgatcgacatcgatcacttcaaacgcctcaatgatacttacgggcatgaggcgggggatcaggtactgcgcgagacggcgcgggtgatccagcatgccttaaacgagcgcggcatggcgtttcgctatggcggggaagagttcctggtcatcctgccggaaatgaacgaagcccaggcgcaaagcgtcgccagtaagctactgctggccatctcaacgcagccgatgatctacgagacgcaggacattggcccggtatccgtttccatcggcatcgccacctggccggtgcacgcccgcgccgataatttgatccgtaccgccgatctggcgctctatctcgcaaaagagcgtggccgcggacaaatcgtgatggcgaaaaaaggtgagtaggggcaggcggctattaccgggaattagctctcttttatgatgatgctctgctgtttatcgccgcccgctctccgttaggctaagggtaaattgatgacccagtgaacctgacatgacccagccgacaaaagagcaagtgattgatgcgtatcgtttgatccgcacggaacaaccctggaagtttgatgcctccgacctgtctcatcaccgcgtactgccctatgccacgcggtcgccctggttagatgatcctgagtttttaagcctctacgaaaaaattaaagggcatacgctggtcgatttgtatcgctgctatgaattatggctgctggcaaagcagaccggtaaagttgaaggcgtggtgctggaagtgggcgtctggcgcggcggcaccggcgcgatcctcgcacaggccaccaaagcgctgggtaaaaaagtctatcttgcagatacctttaccggcgtggtgaaagccggggagaaagacacgctgtataaaggcggtgaacatgcggatacgtcgctggcgatagttaacgcgcttatgtcgtcactggcgattgataatatccagattctcgaaggtattttcccggacgatacccagcatttactgccggagaatattgccctgctgcactgcgacgtggatgtgtattcttctacgaaggatattgttgactggtgtctgccgcgcatgaataccggcgcaatgctggtatttgatgattacggcttttttggctgcgaaggcgtcaccacgttctgcgatgaattaaaactgcgcaacgatcttattttcacgcacaacctgaacggtcacgcggtatttgtgaaaatctgaatacagtcgctggataatcaggcccaacggtagcgttgggcctgaaaagcgcgatcaatagagacgaagcgttaattacattttcctgtcggggcttttagcgggccgcatgcactgtaatccagcagcaggtagccttttcgctgcatgcaaatttctatcttcccgatacggtttttatgctgctccagactttcgccagaatgaacataattccggctaaaatcatccggcgcgatgtttttatccagcccgcagctgtagagatcccgtgtacgctgcgcgacgtcggtatgcccgagctggcccggtttctgaatggtatgcgcatacggaaaagaggtgtaattgctggaatccatatcacccaccacgcaaccggtgagcagagcgcagagtaacagcacggttttattcagcatggctaattacattttcctgtcggggctttcagcgggccgcacttatcgaagtcctgcaagatatagcctttgctttgcatacagctctcaagcttgctgattcgctttttgtgttcttcaagcgtttctccaggaagcatagaaccgcgactgaaatcatccggcgcaatatttttatccagcccgcagctgtagagatcccgcgtacgttgcgcgacgtcggtatgcccgagctggcccggtttctgaatagtatgcgcatagggcgggtggcgaaaattggatgaatcaagatccgccaccacgcaccctgtaagcatcagccctgcggcggccaggcatacaacatgccggatcgccattagtctgtgcataacccggtaggggctttcagcgggccacagtcatcaaaaccgtaaaccttatagcccttgcctttcatgcagctcagcactttattgcgtcgtgcattgaactgttcagacgtttcgcccggataagaaccgttcaggctccagtgcggatcgtcaagatccacttttgggttcacgccgcaggcatacagatcggttttgcgctgctgcacgttggtgcgcccggcggcgtcaggtttctggaacaatttaatccacggcacatagtcgtagttagaagagtccatatcggcgaccacacaaccagtcagcagacaacacaacagcagcaaaattttgggcattctgtctcctaattgcatttaccggtgggcgcttttaacggaccgcacttatcgaagtcctgcaagatatagcctttgctttgcatacagctttcaagcttgccgattcgcttagtatgctcctctgaggtttcgccgggacgaagctggttacgactaaaatcatccggcgcgatgtttttatccagcccgcaactgtagagatcctttgtacgctgcgcgacgttggtatgtccgagctggcccggtttctgaatagtatgcgcatagggcgggtggcggaaattggatgaatcaagatccgccaccacgcaacctgtaagcgctagcgctaatgccgctaccatgcctgtacgaaatatcattagtccaccttagtgagaggcattaaaaataaagtccagcagttcaggagaaaccacttcgctcatcgcgaatggtgcagccagcggaattgctaccacagtccatgtctcagcagcgcctttggtaaacgggctgcgatcgcgcgaggtattgccttcgttgtcatagaatcctggcagctgaccgccaattaaatcgtgtgttccggcaaatgactcaactatcgtatcccctatatcgcccaggaaggagcccggtttatattcgccgaaaggcaccaacaagccgcccgtggcctggaagccgcctgttggcccaaacagacttttagcttccgggctttcttccaggaatttttcaatagtagggtattggggcgttcctttataaacaaccataccgcgttcatcgcgttttaggacggtattattgttttcaacaaccgtctcgcagcgttcattgttatcaccgcaaatagcatccaggccgatccttaccccgcctgctttaataccgtcatacagtccgttactctcgccggaaacattggtataaatctttttaacgtcggtaataccgtcaaacagcagggaattattaattgtctcctcacgcatcttcgtcgctgcgagagagagtgtcccctgggtaatagctgcgtccggcgaaccggctaccacgcccaccagcgtttgcaggaagcgacgctgatactgaagcttatagacttccgccagcgcggcatcgcgtttttcgatatcgccagacttgattgccgcctgcaagtcagcgcgcgctgctgcctgcttaccatccagataagagttgatctggttgttggcattctccttgaaatcgcgcgtcactttcacctgcaggttcagctctttcaacaccttgtctttatcgaagttgtttgcaagcttgccggagttcgcggcggcggtttccgtggtgatgtcggttttgacgccttccacggcctgctgctggtcggcagggcgggtaagggtgatattgctggtgttgataccgctgcgagtgaccgagctttcactgtcgctgtcatgcccgataccaaagctgacgttcttatccagcgaggcataaccgtttgccggtacgtggtagccctcttcggtggtgacggttttgttgctctggcgggtagcatgatcgcccagacccagatcggtattcatgctcatagagccgccaatgccaaagccgttgccttcgtattcggaacggttattgatatcgctccagctcagggtgccggtgctgagctggtttctgcctgccagttcggcgctttcgctggaggtgatcagcccgcctttcaggtcggtatgatctttcacgttgatgttataaccgttttcacccgcaaagacgccggactgctcctgcaccgaggcgtaatcagcattgaccttcgactggctatagttgcccgacgcggagaaaccgtagccaaccgtgacctggccgcccatatctttctgctgaccgttgtagcgcgaggtgtcctggaggctttcgatattcaggttttccgccgtaatatccacgcctttgcccagcacctggccgccgcgcagcgtggtggtgccgccactggtgatggaggtgaaaccatccagatcgccgacatggctgttgcgccagtaaacgtcgtcgccgttgccatagcctttgcctttggtagcgcccgcagtaacgccgaaggaggcgccgccctggccgtagctcaccgccaccccggcgttccagccgctggatttattgtcgctgcgggagtgacgctcctgctgcgcggcaacgatattgacgtcgttatccgcaaacagcgtggtgccctgtttgccgctgatgtcagagccgatgatattgatgttggattgctcgccgccggtcgccaccaccaccgcttgtttcccggcgttcactttactggcgagcgcgctggtgctggtggtgtcttcggtattggtctgcttgctctgaccgtagctcagggacacgctgacgttctgcgccactgcctgcgcgccgttatccatcacgccctgcgcggcgttcatcatggtgctcgcagcccgcgcgctgtcccaggcggcgttggcggcggccagcatattgatgcgatcgtcattactcttgccaacggtctgcgtggtgttgatgacgctttgcagcgcctgcaccaccggcacgttcaccgccagcgtaaaacctttctgctcaagggtacgtttgtactgcgaagcgtaggtgtcctgtgccgcttcgatagtgacatttttaccctgaataccgacattgccgttcggcgaggcgacgctgctgcccgtctgacggtagtcgttaccggcaatcagcacggtgtccccttgcaggctgccgaccatcgacccctgaccggccttcgcctggctcgcctgctcggtggtttccttgcgcgagccgacggtaaagccgatgccgccagagcttaacaggccggattttttctcctgcttgaggtgcgtttcgtcgttgcggccgcccatggtggtgagggtcagatcgttgcctgcgcgcagcgccacgtcgttagtgccgacgacgctgctgcctgccacggtcaggttgttgccagcagcgatgtttaccgatcccgcgctcagctcgctgccctgcacctgctgtttatcaacggtgtcgcgggtagtggtggtggttttcgacaaccaaccgttgccgcccaccactttgtgccgctcgtccagcgtgctgtcgttcagtacgccttcgatatttacgtcgtgaccagcacgcatggccagcgcgccgtcagatttcaccgccgcgccgcgggcattaatgtcattgcctgcgcccatcaccacgccgccggtggcgctcaccaggctgccggtgtgatcgcggctgctctgcgtcagggtgttgtccgcatcccacaccagcttatcgccgcgcgcggtggtgacggtatccaggttcagatcgcgtccggccaccagctgcgccttgccgttttcaccgctggcgatcacctgcgcgccggtcagggtgatgtcacgcccggactgcaacgccagtttgccgtcatctccctgcacgtaaatgccggagacgctgttgatggtggtgcgggtgaagctgttctcaccgctggcactctcagcgcttctcaccgtgctggtgacgttaatatcgcgacctgcattcgccagcagggtgtcgttgccgatgatggccccgtcgatactgttgatatcgcggcgggcattaaggcgcacatctgcgccctggatcaggcccgcctggttggtgatgttatcggcgtccagttgcagcacgcggcgtccggcgatggtgccggagttaaacagatcgccgttgagcttcatcgagacgttattaccggcgatcaacgcgccggagccgtcgatgtcccctggtttcactttcgcgtacacctgcgggatcagcacgttctgcatggagccgtccggcatctgcacgcgggtattcaccagccagacaatatcgccggtcagcagcgccatctgctccggcgtcagcgccacgcccagtttcagcgagtattgtttgccgaaggtgatgcccttatccatcagcgctttgaactgctcttcgtcgttgttgtagccgtcgaggtagcgctgaccggtgatacccaccacctgctcgcgtaccagccgctgctcgtagtagccgtcgcccagacgtttgatggtgttatcgccgtcgttggtgaaggcgttttgcatatagtcgctgccgagccactggcgctcgttggtaaagcgcggatcggtttccaccagatagggcacgtccgccgacgggttcactttaaacaggctgttgtccggcaacgtggtattggcgccgataatgcggatcgccccctgcgccgggttcacttcaaactgttgaccggctggcggcgtgacgggttcgcccggtgaaaccgtctgctgccatggcgcatgaccggcatctttgacgcccgcgttcaccagattcgcccgttcaatagtgacgtcagtccccggcgttttcagcggattgagggagagattgctgccctgtacgctgccgttgctgaccagctggcccggtttcagggtaatggtctggatcgccgtcggcggcacataggcagttctgtcgtcaccctgttcatcgctgcctttatgacggatgcggtaatagtgggtgacggtaccgacgtcggtggtgtggcgctcgccgtttaccgcatcgtttttcacctgggtcacgccgtcgatatcaagcgtccccccggcgatcacctggctgttgtcgttaaacagccgatcgccggtgatgctcatatcgccgcccgcgaggatcttcgccggatcgctctcctgaatgcgcgtctcttccaccgtgcgggtgtaatcatactggttgaaattatcgttaccgtgtccgctgcgctccggcgtattgaggttgcgcaggccatcggaggagttgccgtcaacgtaaacgccttcatcgcccgccttccagcggttggtcgagccggagtgctgatactcggtgagatcttcctgcgagacggtcaccagcgcggtggagaaatgatcgttgatgttgttgatctgtccggcgttgatacgcatgttgcccgcagattcaatggtggagctgtggttattgatcgtacccgcacgtcccgtcgccacacctttatcatccagcgtgccgccgatcgccatgtcgcctgcgctgtaaatcagcgcgtgatcgcggttattcagtgttccgacgcccagatccacccgctcacgcccggccagcgttgctgccgtgccgttttccgtgaggttattaaaggttccggcattgacgcccaccacatcgccgtaaatacgaccgctgccgatattgttcagggttccggcattgatgcgcgtaaggctgccgtcgatcagaccacggttatccagcgtcccctgtgcattcagggtgttacgcccggcggtgatctcgccgctggcggtattggtaatattcttgctctgcacgtccagcgcgccgcccgccagcagtttgccgctgttggtcagatcgcctgcggtggtcacagcggcgttgccgttggcggcgatggtgccgctgttatccagcgactgcccgctgttgagcgtcatatcgcccagcgacagcagctgtccgctgccgtcgatataatctgcgtctaccgtcagctgtttaccggcttttgcggtgccgccctggttacgtagttgcagcccgtcgccgcccagatccagcaggccggaggaggccagcgcccccgcgttgttattcagctcgccgttgttacgcacggtgagggcgtcgtccgccagaatgctgccgctctggttattcaggctgtcggtgttgagcgccacgcgctggccttccagcccctgattgtcccccagcgtgttctggttaataaaattaacggcgttgaccgtcaccgcctggccgccgcggatcagccccgagaggttatccaccacgccgcccgcgctgtcgagcagcagatcgcctactgactggatctgcccaccgctgttttgcaactgattgctgtgcagacgggtggcggactcgccgatcacccggccgccgttctggttattgagcgtgccggcatcaatatcagccgcgccttttgccgccagcgtgccgcccgcattgttcagctcgtcgccggaaatattcagcgccccgaggctgttcagcgtgccgcccgcgttgttcagatcgcgggtggtgacgttgacgccgttgccctgcatcaggccggaagcgttattcagcgaggcagcaggggagagggcgaggccgtcagtggcaaccagctgtccgtcgcggttatccagcgtctggccgtcaaaggcgatatttttacccgccagcgccacgccgccgacattatcaaacgcgcctgccgccagcgtcatatcgccaaggctggtgatgccgcctttatctccgctgttacggttgctcagggtgtcggcgctgatacgcagcgcatcgccgctctggatcagcccgccgtcatcattggtcagggtggtgccgtcgagggtcagcgcctgctgcgccgccagttgcccgccctgattgctcagggtggtagcgttgatagccgccgcgtcgccgctgaccagcgtccctttctggttcaggacctgatccgcattgagcgtcagcgccttgcccgcacccgtgaccccgtcgcggttatccagcgtgccgccgttgaggttcatgaggtcgccggatttcagcgagccgttctggtttttgagggtggcgaaacgcgcgtccagcgcctgttcagaaccgagctggccgccggtgttgtcaatatcgccgccggtaagggtaaagttgccgccgctggcgaggaagccgtcctggttattgatcgcgccgctgctgagatccagcgcgccgtgggagagcagcgatccggcctggttgttaagcgtgccgttgttgagcgcaagggtcgcgccatccgcaacaatcaccccctgctggttatccagcccggcggcattaatacgctgagttttcgccgcttcgatacgcccacgggtgttgttcagggtttgtgcgctgcgaatatcgccatcgcccgccgaagcggagatcaggccgtcctgattagtgatcgtcccggcatcaaggctggcgttacccgccaccgccagcagctggccgccggtgttatcaatggactgcgcgcccagctgtacgttgccgttggcggcgatctgcccctgctggttatcaatgctgcccggcaggttaacggcaagggtgccgctgcccgcctgaataattttacccttctggttcgacaggctgcccgcgctcaccgtgagcgtatcggcgctcagactgccgccgttattgttgagcagtttaccggtgcgggcggtgacctcgctggcgttaacctgggcattttgcgtgttcagatcccccgcgccgccatccagcaccacgcgttttgcctgagtctggctgccgctgacgtccacaccccggccgcgcgcgctgaggttgccgcctgccagcgtctgcccgctggcggtcagttgtccgctggtatccagctgtaaatcaccggcatccgccagtttgccgtcgttattcaccccggccgccagcacgctgtttttactgctggtgagggaggcggcgcgaacctggacattattgccggcggtcagcacgccgctgttgctgaattcgcctgccgtctgcacggcgacattttcgctgccgcgggtgatgccgctgttttcgatgcgtccgtcagcggtcagggtaacggtaccggcctgcgcgccaatggacccggcgttacgcacgccgacgccctgttcggtgccgaccatgcggatcttaccggcgtacatgccgccgaggctggagacatccaccgccagttgcggacgggtggcggcatcgtcgctgcctttgctgatctgttcgtgtgcggcatccacctggttgcgcccggtggtgactttcagatccttagcccacagcccggcgttcactttcaccgaacgggcgatgatgtcggtgtaatccgcgcctgaggtgtccatgcctgcgccatccaccaccacttcaccgcgttcaacgttatagccggtcaggttgccgttgttcatctgcgcctgaccggtggtcagggtggcgcggttggtgttgataaagccgcagccgctacaggtgatgcctgccgggttggcgatcaccacctgggccttttgcccggcgacttcgatcatgccgttgagcttgctcggatcccgggaattgacctcgttaaggatgatcttcgcttcgcctctcgccagccacgggttggcagacaccatgccgcccagctgcgtctgcacatttttatgggagttgttaaggatcgccccctgctggttaacgtcaaacttgctgtaattgttgcgcgacacgcccgccgccgacggcgtctggatattgacctgcgtggtgccgttggcgctgttgagcaccgtcggctgctggtttttcggcgcgccggcgtcggcgataatatccgcctgcgccgtgtgcaccacgcccatcgccagccacaggctgaagctcagcgcgctgactttgccgacgaggcggctgtgcgtatgaccgatgccggaagaacgggaagaacccgcgcggcctgagcgggcgatgtcggccaccaccatcagcatgccgcgtgctttgttgaaaacgatgcggtacaggttcttattcatggtgcattcctttaaaaacttccggcagattgacgcttaacggatgggcgtgctgccaggcttgtgcttgttcgcggctgacgtggttgccgtgcagcatcaccacgcgtttgccgagttgctgcccgcgatggtgcagggcgcgcagacagtgatcgggaaagagatcgcggcgcatcaggctgcccatcgccgcggtatggccaaagggggcgatccagtcgatacaccacatgcggtcgccggaggcccagtcttcatcgcgcatttcaatggccgggcgcgtgaggtagcgggcttccgactccggatcgagccaggcccagctgaaaaagaaaatcggctgttcgtctttcgccaccagtacgtactggcggcgtttaatgatcggcagcagcagcgtcggcagcgcgtgcagaggcgcatcccggtgcagaggggagtgcatccacagccagacgctggcgcccaggacttcggcttcgttctcatcgccgccgaggatcagcggcgctttgatgtcatactcgccaacgcgcattaccagctccagttcaggttaaacccgagggtggtggaactggtgcggaatccgtccggcttcgagaacggacgtccggcgaacaggtcataaccggtgttaaacgcgctaccgcgcagaccgaccacgccgcccgccagatgcttgccgatgagatattccgaactgtagccgcccacttcgccgtaatctgcgccaagatagagttcctgattgggaacgggcgtgcgccaggcgacgtcgttacgcacataccagccgtggctggcgctcagtgtacgttcgccgtcaaagccgcgcaccgtccagcggttgccgatggcgaactgctcctgcggcgtcagcggggtgttgctcacctgacgctggtactggacgttatagcggaactgctgcgagccaagctcaaacggcagatccagcccggcgctaagctgaataattttgctcagggcggttgcgtcaccaaaatactcttccggcgcaggctgcgcgccaaaccagcgggtgccgcgctgatagctgatcccggcatccagcgtcgcctgaccgatatagtggcggtgctgcaagccggcgcgccaggcggcggtctggcgatgctgtacaccgacttccgtatcatcgatatagttgcgggtttcgcgggtcaggatctcatagctaaatgaggttttctgcgagccgctgcggtgcagcacacggcttaactgcacgttaaggtttttgcttttgccgctgtagcggtaatcggcgttctcaccggcaacggtctgatggtaatcaaaatcgctgccggtgacccccagcatccagtaaccgaagggcacggaatagtgcgcggtatagttcttgctgcctttaccgcccttgttatccagatcgtgactggcggagaagtataaaagatcgctcagcgagaaggggttatccagcgacagggtcgcgccgccctgatagcgtccggtggtttcggtgccggagtcatccagcgacaggcccagacgccacattttcgattgcttacgggtgatgaccacatcgctctcgccgggtttctcgccggggacaatctccatgctcgcctcgaccgtaggcagacgctgtaagttttccagcccctgttcaatgtctcgcagatccagcagcttgccctcgtgcgccgggaaggcgctgtaaagctggatatagtcatcgctgtcatcagtcagtgctacgtgacgaatattgcccggcacgatagccagcttcagggttccgcttttcagatcctgcgatggggcaagaacgcgggtggtgatccagccgtgatcgacgatgcggttttgcagggtgctcatcagcaggttaatgcctttcccgcccagacagcgaccctccgcctggctggcgatatgctgtaacggcaaccagcgcggcagggcatctttgccgctgatttcaacgcggttaatggcaaagcagggcgtttcggtcgggaaattaatgcgcccataaccggtagagggttcggataaacgaacgtccggggtctgtggcgttagctgctgctcaatcgctctttgacgctgctgctgaataataaattgattatcaggttctgcggcaaagacggaaaacggaaatggcaggctgctaacagccgatattattatcgctattttatgtgacgaattcatcggacgttccgcgctgtgtaataaaaaaggaagcaatgtgaagatatgtaaaattgtttaaaaatcgacgactcaagaaaagggggattaatcctaaagaccgcagattgcgcctcaggactatccccaaatctggtaggaggaggtaaaaccagcctgcacaggtgaaataagaagcggcttaagcaagttttggcagcaggttcagggtattgccgaaccagcaaaggatcaccaccaggccaaataaaatcaccagcccaggaatgattttaccgccccacaccgtgaattgttgttgcgggaatttttgccgtgatttcagcgccagacaggccgggactattaccgcccagatggtggcgcacaggccagcgccgccgatgccataaataaagccgttcgggaagatcagatagagcgcgcagggcggcagaaaagttaacagcagggttttaaagcgtccgccgggggaattatccattttgaagagatcggccaggtaatcaaacagccccagcgtcacgccaaaaaatgaactggcgacggcgaggttggaaaacaccagcaaacaaaactcaatggtgccgttctgcttcgtacctaaaaaggatttcaccagcgaatcgacgttgccgccggaggcgataatgcctttaaaatctgcgcgcgggatgttgcccatggtgcagtacagccagaataaatagatgaacagcgccaaaagcgaaccaaagaccagacttttaaccagcttatctttgcgtttgccatagcaaattatcaggctgggaatattgccgtgaaagccaaaagaggcgaggcaaaccggtatcgccataaaaatataggggaagtaaccggctgaatggtcggcaacgttactgacatcgcgcagaatggaataatccacctgaaagaaaaaggagccaaacaccaccacgaaggcgataatttttatgccgagaaacagtgaggtgatgcggctggccgccagcgagctgaaccataatacgcaggcgacaaacagcgcagtaccgatgccgatggcgcgggcgtccacctcatgtccggattgcatggccagggtttcactgatgatggcaccgttggcggagatatatgcataggtcaggatataaagcacaaaggccacggtgatcccgctgaacagattccagcgattgcccagcagatctttggtaatggtattaaaactcgcgccgacgggataattgagattcgcttccaataacagcagccctgaatgcaacatggaaaaccaggcgatgatcagaatgaacgtcccccagaaaaaccacgcgccggcgagatcaacaggtaacgcaaacatccccccgccaatgacggttccccctatcaccatgatcccccagaaggaggagtgttttgcctcatatttatcgtccatgatgaccacttgcccggatgtattcatattatgatcgcccataatttattatgaaaacgctgtgcacagtcagcagcgggctacagggatgctgtagcccggcgcgttgcggaagggaatatcagacttcttttaatttcgcggtaaagtgacgtaatactttgggttcatacgtgaaggttaaaccttttatattgggcgcgttttcttttacatgctggaaggcttcgataataaagtccatatgcgattgcgtataggtggcgcgcgggatggtcagacgcagtagttcagccgggcagggcaattgtttgccggtttttggatcgcggcctaataagaaggagccaatttccactgcgcggatccctgccactttatataattcacaggccagcgcctgggccgggaactgttctgccggaatatgcggtaataatttacccgcatccacaaaggcggcgtgtcccccggcctgctgacaggtaacgccgatggcttccaggccgtccaccagatactgcacctgcttgatacgataggccagccagtcctgattcatgccgtcagtcaggccaaccgccaggcgttccattgcgccgccttctaacccgccgtatgtgggaaaaccttcctgcaccacgcagatcgtccggcattcggtatagacatcaaggaagctgtcgtccttaatgcataacagcccgcccatcggcaccatggcatctttttttgccgacatggcgagcatatccgcatatttataggtttcgcgggtaatttcctccaccgaccagtcgcggtattctgcttcacgttgctgaataaaccaggcgttttccgcaaagcgcgccgagtccatcactaccggaatatcgtatttacgggcaatggcatacatggcttttaagttggcgatggacaccggctggccgccagcggagttacaggtaatggtggcgacaatatagggcacgttagcgggtcccacttcctgaatgcctttctccagcccgtccaggtcaaaatcgcctttaaaatcgcagcgggcggaggtatcaaacgcctctttgatataaacattgcgcacggtacaaccattaatttggctgtggccctgagtggtatcaaagaaatagttagagaaggccaccattttgctgcggtcgagccctttttcctgctcacgttttttgatcaataccggaatataaatctgctcagcgccgcgcccctgatgggtgggaatggtgtgctgatagccaaaaatattttttaccgcctccgccagcgcataataacttctgctgccgctgtaggcttcatcgccccgcagcatggcggcctgcatattctgcgtgaccgcgccggtgccgctgtcggtcagcagatcgataaacacatcttcgctgtccagcagaaagggattcatgcccgatttaagaatggcctgttcccgatgttcgcgggtggtgcgttttaccggttcaataacgcggatgcggaaaggttcaggtaagtgttgaaaattgttcattgttcaatcctgtatttatggcgatgctaatgcctgcgctttaattatgcgcagacatgacggagcgctgccggataaagggcgcggcctcggataagatttattcagaatatgccgggcacacacgcagcagacggatctatcctgcgcggtaagtcatggcaaaaaaggagggattaagggcggtgattgacaataacggtatcgaggttaaaccactttgcggtcatatatgtgaaatttaagataatcatagtttatcaactcacattaaacatgatactacagtattacatccgcatcctttgtccacggcgggatttattaattgtgagttgtctcacgattgctttttgcggcgtttgcggggaggcagccgtagtttcctgatcatgaatatccttaacagcatgggataaaagaacatttaagccttacgacttaatgctaatgttccggcatagcaccataggggcagtgtttaaaacgacagtcgggtttttttgtgcagccatgaataaacggctcggtatttcctgggcactggatattattgctgaaggacgcccacagcgagggtgagaagggaaaagcatgaatgacgttgatatcgcgcttacggtcgttagcaacgatgccgaaagcggtagtggataaggtgttgcctttgtgcaaaaaataatctccgcgataccataagatgagatttaaattccgcacgccagatacaactgcgaatgccgttcccgttttgggacacgcgagagcctgtttaacaaaccattccatattaagtaaattctccataacttatttcgagccagttaggtaagctcttaggattattcttttatcccacgcgccaaggataacgactgagcgttcagtgtcgagggtgctttaataaacattcctaagctgacaaaataaatgtttctatatgtttccttgcaaaagatagtttaataatcagtcggaaagttgaaagcagggcataattggcggtttacactaaacttttatccacttaagcagataaaaggagcgcttatgaagttatggcctgtagtgactggtgtggcgattgcgttgacgctggtcgcctgtaaatctcccacgccgccaaaaggcgtacagcccattagcggttttgacgccagccgctatcttggcaaatggtatgaagtcgcccgtctggaaaaccgcttcgaacgcggcctggagcaggtcaccgcgaactacagcaagcgcagcgacggcgggatccgcgtgctcaaccggggatacgatccggtgaagaaagagtggaatgagagcgaagggaaagcttatttcaccggtgcgccggataccgccgcgctgaaagtgtcgttcttcggccccttctatggcggctataacgtgatcaagctggatgataagtatcagtatgcgctggtcagcggcccgaaccgcgactacctgtggatcctctcgcgcacgccaaccctgccggaagcagtgaagcaggattatctgaacaccgcccgcgagctgggattcagggtggatcagctggtgtgggtgaagcagtagccttctgttctgaagcagaccctgcgcaacggtttaagtaagatctgccatcaccttgcgcaggacatccttcaaccagatcagcgccatatccttatcgcaccgcttatgccacaacagcgaaagggcaatctccggtgtttccaccggaacgggactgcgccgtaaaccgtaatgcgccacccagtcgtccgcaagcccggacggaactgtggctaacgctggtatgcgcgccatcaaaggcggcagagaggaaaagtgtggtgtcacatagcgaaccgaacgcgctttacccagtgctgccagctggtcatccaccgcgcttgaggtcgccccgcgataggaaaccagcacatggtcatgtgccacgtagttttccagcgtcagcggcgcctgcagggaaagctgttcaggatgccagagcgtacagaaatgatgtgacacaatcttttcacggcgcagcgtagcgggcgtgctctcgccaaccgaaatggcaagatcgacttctccgcgcgcgacgagttcagcatcccggaagggatcgctggccctgacctgaagagtaacgcctggcgcatcgcgggtgatacgcgcctgcaattccggcatcaaccagcgctcaacccagtcgctcatcccaagacgaaaaacatgcgttgccccggctggcgtaaatgacgctggctgaaaaagcacgttctgcatctgttccattaaaggacccagctcagcgatcagcgcttcggcacgcggcgttggctccatgccacgtgccgtgcgtacaaacagtggatcgtcgaacatgccacgtaagcgcaccagcgcattactgaccgcaggctgaccaagatgcagcttctctgccgcgcgggacacgctgccctctcgcttcagcaccagcagtactgttaacaaattcagatcgatacgatgaaaatcattttcattaatagtgaacattactttaatcaatttgaatgatgtttattgcctgagcatactgtgaaccacgttctggtgatacttcttaggaaggtttttgatgaaaattttactgacgctggtcgcttcacttcttttttccggtccgctagtggccgctgaacaaaccaccgccctggatcaacaggcgccgggctattaccggatgctgctgggaaaagtgcgcataaccgccgtatctgacggcacggtggacgttcccctcaatacactgttaacccatatctctccggaaaaactgcgtaaggccatggataaagatgcaatgacgccgcaggccgagacatcaattaatgcctacgtcatcgatgatggtaaaacacgtgttctggtggataccggtgccggggagcttttcggacacaacggcggacatctgctgaccaatctggccgcggcgggttatccggcggagacgattgataccgtactgctgacccacattcatgcggatcactcgggcggcgtctcccgggcgggcaaacctgcttttccaaatgcggaagtgtacgtggataaaagagacgtcgatttctggcttgatccggctaacgaaaacaaggttgaggccagtcaggcgcatacttttgctgaatccgagcgcaccctgggcccggtcatcaaagcggggcggttgaagaccttcctggcaccggccatattaccgggcggaatacgggcggagtctactgcaggtcatacgccggggagcgtgctttatcgcgtggaaagtgaaggccagacgttggtgctgtggggcgacattattcacgcgaaagcggtgcagatgcccgatccgcacgtggcaattcattttgacgtcaaccaacagcaggctatcgccacacgtgaaaaaatactcaagcaggctgcggatcagggttactgggtggccgccgcgcatatctcttttccggggttaggacatgtacagcatgacggtagcggctatcgctgggtgccggggaattacacgactcagctcgggcagtaggagcgcttgaggaaatgggtagggatacaacctgggtgggcttaaaatctattcgtttaaattgattattttccgcagaataatattaaaaggataatgactattcgatatttatctaattttttatacggatcagaaagtctgaaaagccatgtgcttaagcaaagttaaaactgtgcttagaatgatacccgtgataatttttaatagaaaaagcatgtgatatgactttcttatgctctacagaaaatagagcttgctttttattgcgtttttcggagccatgagggagggaacccaaaatgcccggtaaaggcgcgtgtaaaagactgcaatgactcaaatccatacttgatcgatatagtagtaattgtatctttttgcattattatgtcgcgataagcgtactcaagcttttttgctttgatgaagaagcctggcgctattcctgtatggctcttgaatattctctggagatgccattttgaataacctgatttcacagcaagatcatccagtcgtatattttctgtgatatttttttcaatccatgttattaaatccgtacaaaagtttgacttattcataatacgacttgctttgaattttaaggattaaagaaaatatgctattttaaaataatttctgttgccgggcttacagcccggcattatttttaaaaagtatatgaaaaaccagcccagaaggacagaagagaatctttttctaccatcggactattttttacagcgtccggaagtatggtgtaacgtgagccaccatatatgttccagctatctgtcagcatatagttcatgttgagttcgacataaggtgttatactctcaccgggcgtgtattttttaaagccacttcttcccgattccttgttatttatgccgtaataatatttgttaaatttacggtcattccagttaaagcctagtgaaggctcaatgcttaacaaaccaatctgtaccggataactccatgcgttattccagtataaaccattacttgtatctaaagagtcagttgtaagcgtagtttcaaatttccccatttcaggcgactcatgtgaataacttatccctgtcattagcgtgctgtgacgattatttagctggcgcatcgcccttgagtggctatcggttgctttaaaagaaagaggtagataatatccaagtatcgcaatgcgatcggatggcgtatgaagaaaatcatacccagcactcagaccatgaaaccagaacggccctgcttcgtaatcaacgttaggaaaaacaaggttgtttttattctcatcaacctgcttgtataattttgaagaccatccagtggtcaggcctaatgaaaaatcatctgcctgagcggcctgcaggaaagctcccgttagtatcgccaccgaaaccactgactttattaaattcgtcatactgtaccttgccaaaaaattccagcttatatttattttgttaaaaaacttagtcgatcgatacctaattatttatctatatcaatctgacttctgataaatttttctgtattttcaatatactcctggtacccaaaaccttcgattcccagactgagtatcccatccaggccatgagaataagcgataaaatcccacgctattaattctttaggcctggtatatttgaactctccgtttgaggctcctttttcaagaagattcataatggcttcatgccattgtctgaccaccataccaaatgctttacgcatcgtttcatcatgaaaagaataaacttcggcttctttccataatttactgtagtgatgcgcatcctcatgattctcgacgaaaaggcaccagtgaagcatatccaggcagctggcgttttcctttatacccgcttcatacatatgtttcagagcctgatctaccgagagtttaaaagcttcggccttcagatcggaggctgatgaaaaatggtgatgaatttgccctatagctatctcagcctcctgagcaactcttcttaccgtcatagctgataacccttcctcatacgcaacttttactgcagtttccaggatcatctgacgtctcacatcacgactgagataagacatggtagttttgactcctttttgcactcaatctggacattcgttcaagttcactataaattcaacttgaacacatgtccatatcttaattttttataaggtagtaacagcatgaaaagcaaatggtacgtacttttagtagtgattatcatgtacttacctgtttcgatcgatgccactattctttacgttgttgctcccgttctcagcacgcaactccaggcctcgcataatcagttgctgtggattatggatatttatcccctcgtaatggctgctcttttgttacctatgggggcgtttggagatcgtatcggctacaggaaaatggcgatttacggaagcctggtttttggtattgcctcgactgttgctgcctgtgcgaatacgccagaaatacttatagctacccgcgcacttcttgcggttggtgctgcgatgattgtgcctgcgacgctcgctgcagtgcgcagaaattatgtggatgagaaagatcgcaatatggcactgggtatctggacaacagtcggtaccggcggtgctttagccgggccattggtggggggagtgctgcttagtcatttttactggggtgcagtatttctgatcaatattccagtagtaatgatagtaatttttttaatttccaaaactttaccagacgaaaaaggcgacattcgccagcctgtcaatctttttcaggggctcctgttaatgagtgcgttgctgatattaatttatgccacgaaaagtctggttaaccatggcaacccgattcttttatctgtctatctgtttttggtcggactggttttgttcggctgtttcattactatccagatggtttctcgttccccactgctcgacacggggcttttgacaaagcggaatatcattgctggcgtgattctggctctggtttcaatgattacgctggttggttttgagcttgtaatttctcaggagttacagttcgttcaccgtttcactccggtgcaagccgggctatatatgatgccgctaatgctggcaagttgtcttgctggaccggtcgctggttatctgattaaccattttggggttaaaagtgtcgctatggtcggacttgctgcctctgctatcagtctttatgtattgtcagatgttaatttcgttagccagactgcaaaagcctggacatggatggtggttcttggggcaggcgatactgtcgctttaatggcctcttcctcagcgattatgacggctgcaccagcagacaaagccagctctgcaggttcacttgaaggcatgtcctacgaactggggacggggctgggaattactgttttcggatccgtactggctggcgtctattccgcgactgttcgccttccggaaaacttgccgcgggatatttatgcctcagccagtaaatcgtttagcgaagctttagcgatctcgcgccacctcgatgaagcctccagggaagatcttcttaaagctgcttcttcagctttcatgcattcccatactgtcatgcttgagtcggcatcgttgattctgacgatgttgatgatcctgactttctttattttcaaacctggtaatgccttcagaagttgatgatggctgcatcgcacttatttcattgattaaatcggaaattcattatgaatatcaggaaactggccatttacacgacgttttgcctgggatttatcaccggttgtgattcgtcagagtcgaacgaaacggatccagtaccagttaaaaccaaagtagtgacaaaaatacttaatgctgaagatatttactccacacgtgtattccctgcccgggtttctgcggtgaaaaccgcacaaattcgcccgcaggtgggaggcataattcaaaagcgacttttcagacagggttcggaaatactacagggtcagccactgtttcagattgatgcagcgccgtttgaggcagatgtcgaaatggctaatgcagcagttgcaaaggcaaaggccacctatcagcagatgagtaagcgggcaagtcgattcgcacaattacaaaaaagcgcagcgattagtcaacaggatcttgaagatgcaaaagccagcagcgcgcaggcagcagcagatctcgcagaagcgacggcgtcacttaaccggaaaagactggatttgaattatgcgacggtaaaggcaccgataagcggacgtattgaccaggagttcattacggaaggggcactggtcagtcccggtgatacgcaagcaatggcggttattcagcaacttgatcgtgtttatgtagatgcccgggtaccagctcaggagcttcgtacaatttatcaggcggttgaaactgatccggctagccagtctggcgctgttgcagatgttcttgatgataaaggccagtcatatgaaaccgctgcccgactcctgttctcaggtatcagcgtcaatgacgaaaccggtgatgttgtactccgggcagaagcagagaacccgcagcggatcctgctgcctggaatgttcgttaagctaaaaatcacgcggctcatccaaaaggaagggctggttgtacctgaacaggcccttagcagggcggatgataaaactaccgtatggatagtagggcacgagaataaagccaggcgcgttgagatccagaccggagaacaaactgaaaaaggcatcactgtaacggccggcctcaaagcgggagacaaaatcgtcattgaaggtcaggacaaacttcaggatggtgccgaagtgattgcacagtctgacgttataaaaaattaacttcgtaatgacttattactacgggaaatgctgatgtctcagttctttatacgcagaccaatattcgcatgggtcattgcgctttttataattcttttgggtgtgattgcaatcccacaacttccggtcgctcagtatccatccgttgcgccacctagcctgtcaattacggtcacctatccaggcgccacccctcagaccatgaatgagtcggtgatttcattgattgaacgtgaattatctggcgttaatgatctgctttactatgaatcaaccagtgacacgtccggggtagcgacaatcaccgtcacatttaaaccagggactgatattcggctcgcacaggtagacgttcagaatcagattaaagttgtggagccacggcttccacaggctgttcgccagaacggattaagcgtggaggctgcctcctctggattcctgatgatggttggcctgaactctccgacgggtaagttcagcgaagcagacctgagtgattactttgcaagaaaaattactgacgagctacgtcgtatcgatggtgttggtaagattcaggcgtttggctcggagaaagccatgcgtatatgggtcgatccttcgaaactcatctcatataagctgtccgtcagcgatattaatacggcaattacagagcaaaatgctcaggtctcacccggtaaactgggcgactcgccttcaactgctaatcagatgacagcttatccgctggacgtcaacggtcagcttggtacgccagaggaatttcgtaaaatcgtcctcagggcgaatcctgacggctcccgcgttacgctgggggatgtggcccgggttgaacttggtttacagtcctatgcgtttgccatcagagaaaacggacatggctcaacggcggctgccattcagctctcaccaggcgcgaatgcggtacggacatctgatgcggttaaaaccagaatgcaggagctggcaaaatcattcccgtcaggaatggaatattccattccttttgatacttcacccttcgtaaaaatctcgattgagaaagttgtgcatacgtttgttgaagcgatggtgcttgttttcctggtgatgtatctctttcttcagaacgttcgctatacctttattcctgccatcgtcgcacccgtagcattgctcggcacctttaccgtaatgatgcttgcgggattttccatcaacgttctgacaatgtacggcatggttctggcgatagggatcatagtggatgacgccattgttgttgttgagaacgtcgaacgcctgatggctgaagagggattatcgcctaaggacgcgacgattaaagccatgaaggagatcaccggagcagtagtcggcatcacattagttctgacggctgtttttctgccaatgggactggcctcaggttcggtcggggtaatttatcgtcagtttacgctttcgatggcggtttctattctgttttcagcgtttctggctctcactttaacgccggcactgtgcgcgactttgctgaaacccgttacggccgactctcataaaaagaaccgttttttttcctggtttaacagaacgtttgatcgccttacgggacggtatgaaaatggcgtaacccgtgtcatacgtaaaaccgggaggatgacgcttatttatatggtcttatgtggcgttctctttttcgcttttaagtttttgccgtcttcgttcctgcctgaggaagatcagggttacttcatcacctcggtacagcttccggcggatgccacgatggagcgtactgaagccgtcgtgaagaaatatgagaagctcgttatggaacgtccgggcgttgaacgtaatgtttcaatactgggtttcagcttctccggcgcgggtacaaactctgccatggcatttacaacgctgaaagactgggatcagcgtaacggcgctacggcgcaaaacgaagtgacaaacgtacaaaatgagctgggtgatattcctgaggcaaccattaccagcctgctgccgcctgccatatctgagctaagtacgtcctcgggctttaccctccgactcgaagaccggtccggtcacgggtatgcggaactggtgaaggctcttaatatgctcctggaaaaggcgggtcagagcaaagctttatatggagtttatatggacggtctgccagatggtatggggatcagccttaaaatagacagacctaaagctgaagcaatgggcatatcatttaatgaaataaatcagacgctgtccggcgccctcggctcaagttacgtaaatgacttccctaacgaggggcgcattcagcaggtgattgtgcaggctgaagcatcagctcgtatgcagctatctgaaatattagcgctgaatgtccgtaataaaaatggtggaatggtgcccctgtctgagtttgttcgcccagtgtggcaaagttcacctgtgcaactggttcgttatcagggatatccggcattccgcgtcacaggatggcctaactggggttattcaagtggcgatgcgatggcggaaatagaaaaaatcgctgccgatttaccaccaggttttgccatcgaatggaccggacaatctcttcaggagcagcagtcagcttcagaagcgccgatgctgatgattctgtcaatgctggtcattttccttgtgctggcggctctgtatgaaagctggtcgataccggtttcagttatgcttgtcgttccgttgggtctgattggggcgataattgccgtctatcttagagggatgcccaacgacgccttctttaaggtaggcatgattactatcatcggtctgtcagcgaaaaacgctattttgatcgtggaatttgcgcggcagctccagcaagagggggagaaccttcttaatgccaccgtgaaagccgcgcgaatgcgtttaaggcccatcatgatgacatcgctggcatttaccctgggggttgttccgctcatgctggcttcgggtgccagtgccacaacccaacaggcaataggcacaggggtattcggtggcatggtgaccgggacgttattagccatattttttgttcctgtcttttttgtcacggtattgtcgctcgttgataaaatcaggaaaaaaacaagattttgacaggcaacatgaaggagagggtaacacctctcctcttatgcacatcatctcagcgtagaacggtacggtaacgattttcaaagacaagtttagaaaatctgtggtgctggtgaggaaagcttaacatcgataaagatacggagaaagtgacctacccttcaggtgtgagagcgataaatcttatacgtgttggatgaggctatcgcaaattagaaatgttcataacagcgcgaaaaggcttaatctgctataaaaaaagcccgcatcagcgggcttttttgtcacttgggagccgtggctcctttgcgtatccttttaggtcacgttactgtctggtcagagtcctaccgtgacacctaacttcctgtttttcaaggtgctgtccttgcactgtccaatcatgattggtggagctggcgggagttgaacccgtgtccgtttttctttaagcggctgaaatataatatcttatacaacgcatatttttctgcggctccttcacggctccttttacgtcccgccactgaccagctttggtcttttctcggtgttgccgtcgtactccttcagataggatccgtaatgcctgaaaagcatctcgggtcctttatgccccatctgtccagcgagccagaaaaggttagccccctggctgatgtgacgagtcgcaaaagtatgccgggtctggtacggatttcggtaccggatccctgccttacgtaaggtgggcacccatgctttttttcgtattgcatcggcgctcgcccatggcttatttgttttcggatcctcaaagatggtcgcgtctttcatgaatgtgaaggacttctgggacgcgagtaccgccatagccggatcgttgagctcgactttacgggttccagcttttgtcttggttcccttaataacgccgacaacgctcgcgctctgcacgtgcgccgttttgccgataaagtcgatatcgcgccagcgcagcgagcagagttctgagctgcgtaacccagtctgaatggcgaacataaacagattttcccattgcttgttgccagcggcagacaaaagagcatccacctctgcgggggaaagcggatcgacaatgtaatcgctgtcagcacttgttttatcactttggtatcgcgatgccgttaccagagatactgggttaatttgcagtacgccatcggtaacggcttcatcaagcgcagaacgcagaaacgacagctgattgcgtatggttttcagcgttgtagtcctgctttgtatccaggctttcattgcagctggagtcaactcactggccgggaatgaatgtaaggctgccagtgcactccggcattttttataaccaccgatcgttgaaggtgataattttcgcgtttcacatatgccaatgtattcatcaaggtacattttgacagttttaccggcagcagcattaccgaatatttttaatcgtgctgatcgcggaaaatactcagcatatacgaaggtaccgcgctcaattttattgtggatttcgcccagtgcccgctcggcatatttgaggtttttactgttcacttccagattggaaaggggttcacgacacttaacccctttatatgtgaaagttatatttatcgtttctccctggctgtgtttccttacggtcacgccgcgcggaagttgtggcgattctgtcttgcccatttagcgacctcactaagatctatccatctttccttaacgccttccactttcagcacctgaacgccttccagccaaacgccacgctgtatacgcttgtttatggcctcaggcgactcgccagtttctttgcaataagtcgagattggtacacaatcgaggttcagcatagtttctccactccggctgcaaccggcttattcatgttaggaattattcaattgattcttatcagtaacggtatctttaatgctatcgacttggcttttattaaacaccatgtcagaatttaagttttcgttgattttaaagcacatataattttcaaagcgctcgtgatagccgtaacgtaatattgcatcaatgaggatgtcttcattgatatctctcaggaaattaaagtggaatggattttcttcattaaagaaatgccctgtatctataatgcaatgtttttcttgagcgcctatcttatagaaaaatatatacatcatcctgcttgttagtgttatttcattaagtttatagactccttttgttatcatgttttgtacgggttcagttatatggctctcaatgtcacaatttattttacacccccctgttgttattatggtgaatgaaattgtctcgagcagttctatattgactaactcaccatgtaaacgtaagttgctgtattttgggatgtctattttctgagtttcatacccttttaaaagaataggtgtttcaaaatcaaccaaggtcaactttcctttattattgatgtccatttcaactctagatattgatattgaattatctcttttattagatattattattgctggtatatgtgaatcataaattctactgctgcttatagaatatgatatgcaaactttttttgatgttttttgatatccaaaataaatggtgaatccggcagcgaagaaagttaaaagttttatgtcaaataatgaccataaccattcgaaaaatgaccacaaaatgagcaggtgttctataacttttggattatacataaaaatcaccgatattaattatttaatcttataatcgtaaatgtattcactcgctaattcaactgcaacttagataagtcaacgagaaaaagaactgatagcttgttatacattagaaatatacatatcggtacatatcaccttctttatttccaaagaccataacgtgaagaaaactttctttatcggagctagatttttgctaaggctcacatttatggtgtagccactagcaaactgcacaatcttcagtcttttgaatggatgcagagaaccagacttgacccgcagggcttcgtgctgccaagttgagagatcatagtcatcattttctggggcgttcccttcttgtcccgatagaccacctgccttctgagatcgttagcattcatccatgcgttgagttcctcgttggagatatactcacgcctttcatagaattcgtcatataccggtttagtccagtagccatactgatcgtgctcaaccgtaagcggagtgattgctaggtgaatgggaggcttgtcggctgcgactgggaaagctgattcacagcgtagctgggcgacatattgctctaaagcgcttgtgacgttttctattacaggcgcttggtggttaatgtgtatacgacgcaaattaactgctaaacccgccgtttctgcgcaccaagagccaaggactgcatcgctggttggcgttttttcgagcgcgtagcaaacatcgtaagtgctgcatggttcatctttgccacaacccatgcagaagtggagtgagtcgctatgaatcttaatttcggactttttcacagcattctctccagtcagttgcttcgcctcgttccgtgattcgcacagcgccgcgaactgaacatcaaggcggtctgctactgcggtcattgactttgctgctgctggtggcgtaacaagggctgttactctggagtcggcgatcaactctttggcattcattcgcatgtaggtatctcctgtgcgcgctgcaacgcgtgattttggttgcccgaatccctcgccagctggcgataattacaagggcctcgcttctttaagcaccgcggcagggcacttactaaagcgggaggttgcaaccgcctggttagttctccacacaactggaagcgcgctccgcggagtttgcattaacgaccagacactaagaggagtgaatggagcgcgctttcagttgtataaaaaagtgcggcgccctcacgggaaaataagatcagacgccgccaacagactacacacgttcgttttattggaattttggttgtgacaccggggcgccacacccgcttacttcccgccgctcggttttggtattggtcaccagtacctgtgactcagccgattttcgggtctttgcgtcggccggcgctgcagctcgcttgagcacatcacaactggaagcgcactccagcacgtttatacctgtcacccataaccgataagttagggagtgcgctttcatgttgggacccggtctttttcatcgcctcgctattcaccaaaaatcaaggttggtttaatctgggattccaaaaaaagtaactgagttcgcacgaagtgatatgcaatacggcgcgaattttaaggatcccagtaatggtttcgttattaaaacaaaacggtaattcctctactggagtgcatatgcttcagcgctcaggcaagaaatttaaatttcgttgcagcatagataccctcgaacgtttcacatctgcctcagtaaaagccgagcatctaaagcagtttacggcccgtaaagatggcgtatatcactcagagctgttcgacactctggagcaaggtaaagcggagttatgcgccttcgttaaaaaggtaaccggcatcacctgcaccgcctgaagcctgttccgacagagtggttttggacttcctagatttttaaagagcgaagcgtcctatagggcgctttttattacttgcgaatcatccggtcattcatatgccaccggcggctacttcgtgggcgtcctgcctgttcgctgttcatagtattaaatgtacctttagttaccttgatggtcaagactccaatgtacttaatgttacatggaggtgcacaaaaaagccggtctaaggtaaccggctatactgtttaacgttaaatattttgggttatctggactactttgcccacgatgcggcagttgccgtcaataggtatggggggaaatgctgggttcaagggcatcaggaaggaatgagggctatcccagactaattttttaaccgttgcctccgaagaaccatctaatatggccacgacaatttttccatacaagctgtcaagttgaccatattgtggctcaacgatcactattgaaccttcgggtattgagggtaacccatgagggttcgtcatagactcgccgcgcacaattaaaccaaaaacttcttcagaaacatcagcggtggtttgtgtccatgtaatcacgtcggtcaaccttgaacttgcgaaagtttctgtccagtggcctgcctggactgcagaaataataggtacagctttgggtggttttatgaatggaataaccctagtgtcatcatctttgttatcaccctggccatataaaagccattcaggcgttgtagataatgtttttgcaagctgatgcaggttctcgccatctggcttagttgtgccattttcccatttagttactgatacgcgactaacaccaagctttttagctagtgcttcttgagttatgtccaactgtagtcgcttggatctaatccggtctttcatctctgttctcatgtaacttatgttacacatttgcatggtaacagttgtttgctattttatgtaccttttgttacctttatgacgtcaacgtataggaggattcatgcacaaaagagaggtagtggagcatttcggtggcatctcaaaaactgcaaacgctcttggtatttcacatccagcagtttgtcgctggggtgaaattatccctgaaaaacaggcattcgttattgagcgaattaccaaaggcaaacttaagtacgacagcaagctttatcaaaagcctaacgaaacggcagcttgaaagtaaccacagaaacaagaggtgaaccgtggataacaaacactggcaggtagaaaaacagcccgcatggctggtggccgccatcaaaaaaaccatatcagaactgccaggcggatacgccgaagcagctgaatggctgggtgttaccgaagatgcattgttcaaccggctgcgcgcgggtggcgatcagattttcccgatgggctgggcaatggtactgcagcaggcgagcggcaagaaattcattgctgacgctgtctctcgccagtcgaacagtgtgaatgtaccgctggtggaaattgaagacgtggacaacgccgatatcaatcagcgcctgatggaatccatcgagtggatcggcaagcactcctcatacgttcgcaaagcgactgctgacggcatcattgaccaggccgaacgcgcacaaatcgaagagaacagttatcaggttatggcgaagtggcaggagcatttgacgctgctgtatcggattttctgcgcgccagaaaagagtgacgcccgcgagtgtgcagctccgggcgccgtggcgtttcgtaaacatgtggagaactaacgcatgaacagtttaacggctatttgccgcttaccgcaactgcggatgatcccggtgccgggacagccgctgtttcggtatgaacgcagaatatcaaaccgctgggtggcgtgtaaccacagccgcgcgcgggcaatcgtgggtgtgtattaccggagggcgaaagcgttatgcgtgaactcaaccgatggttcaaagaccaccacggcattcctgtccaggtcatcagatgggagccagaaacccggcgcgttatctatctgcgaaaaggttatgagtacggtgaatgtttcagcccgctcgaacagttccagcgaaagtttagggaaatagagggcgatcatgagcactaaattaaccggctacgtctgggacgcatgcgccgcttcaggcatgaagctctccagcgtggctatcatggcccggctggcagacttcagcaatgacgagggcatcagttggccttccatcggcaccattgcgcgtcagattggcgcgggcgaaagcaccgtgcgtaccgcgatcgcgcagctggaaaaagacaactggctttcgcgtaaacaacgccgccagggaaaccgtaacgcgtcgaacgtgtatcagctgaacgtggcaaagctccaggccgctgcattctctcacctgtcagatgctgacccttcaaattctgacgcatcaaaatctgatgcatcaaaatctgacccctcaaaatttgaggcatcaaaaaacagggctggcggcagttttgacccgtcagaatctggcggggatccgtcagtaaaatcaactacagatccacaagtaaattcaaaaccctcttgtccggttgcggggcaacccgaccgtgaagttttaatcactgatcaggccaaacaggttttaacccacctgaaccagaaaaccggatcccggtaccaggtctgcaaatcctcgctggagaacatccgcgcccggctgggtgagggctttacacgtgaagaactggttctggttgttgactacagcacggcgaagtggggcgaggacctgaaaatggcggaataccttcgtccggccacgctgtttcagccaacaaaatttccggcttatctgcaggcagctacgagctgggaaaaggccgggcgcccggttcgtgaaaacggacaatgggtcagcgccatggtcgcccgcgccagctatgacaatgttgattactcgcagattccagaggggttccggggatgacagtcacgaacgaaatgcagaataaatattgcctggcgctggccgaactgcgtagccagccagcccatgaactcaaacacgttggcgatcagtggtgcacaccagacaacatcttctggggtatcaacgccatgttcggtccgctggtgctcgatctgttttccgatggtgaaaactcaaagtgccctgatttctatactgccgaagacaatgctctggcgcaggactggtccgcccggctcgaagaactccatggcgcagcctatggcaacccgccttacagccgtgcatctcagcacgagggcgaatacatcaccgggatgcgctacatcatccagcacgccagcgcgatgcgcgataaaggcggacggtatgtatttctcattaaggcagctaccagcgaagcgtggtggccggaggatgccgatcacatatcgtttatccgcgggcgaatcggttttgatctgccgaagtggttcatcccgaaagatgaaaaacaggtaccgtcaggagctttcttcgcaggggcgatcgctgtattcgacaaaaactggcgcggcgcggcgttcagctacatcgatcttaaggatcttgaagcgcgcggtaatgcatttatcgaacagatccgccgcgaagcgctgcgcctgttaccccagatgcagcaacaaaatattccggaagttattcctggcgcaggcgatgaggctgtcgaatgcgcagaagcgctggatttggccgatgaagttgcgctgccagcaccggtaaccagttctgaagacatcctgccgctgagccaggcagatattcttgcgaagagcggtatccaggcatgggcctgtgtccgggcggtgttcggcgacaaggaagagtacaccttcaaagagtcaaaatttgctcacgtatgggcctccgacaatgtttcccagccgaccgttgtcatggtaagcgcaggtgacattgctgtggcagaagttctgatcgctgagaaaagtgtgcagctggctgtcagcgaatggctggatctgaattacccggagaatgacccggcaaaagccgatatgcaggaacggctgaatatcgcaggcatggaagcgatgaacgaatatggtatggcgatccgggaatttctggatgtcatcaaagaaatggatcccgcggcgcgctgcaacattcgcactattcgggtcacgctgaaggatttcagcagcaaagcctccctgaaggaggatgcagcgtgaaaaatctgaccgcccgccagcaggaagttttatccctgatcgtggctttccagaaagagcacggtatcccaccaacgcaaaaagaagttgccgacctgatgggggcatcgtcaccgaacgcggccactgacatgttgcgcgcactccagcgtaaaggcgcggtcaccctgatgccgggtgtaagccggggcatctcgattaacagccagagcgctaatgataaggctatatcactgctgcgctcgctggtaaacggtgaagagaatgccagagcgcgcgccgccgcgttccttgggatggaggtgtaaaagcatgatccattatcacggtggtccgattactcctgatacctgcgcaatccgggcatggaaagcacggcatgcatttatttcgttcgcgcacgcgggtcagatagccctcgccgctgaatattgccagtcttttgccctcgacaatggcgcttttaccgcgtggaaagcagcaggtcgtaacaaaatcgactggggtgattattacgagtttgtggctcggtggaaacaccatccagggtttgatttcgctgttataccggacgttatcgacggtggagaaaacgaaaatgatgccctgctggatgaatggccacatggtgatttttacggtgtgccggtctggcacatgaatgaaagcgatgagcgttttattcgactgtgcaaagccttcccgcgtgtggcgatcggcagttgcggtgaatatgacgttaagaggcctaatctggcagtagcgagaatgaaagatctgatcagacatgtaactgatgagcatggtcagccgatcgcaaaactacacggtttgcggatgctgaaccctctaattttcacaaaactgcccctttccagcgcagacagcaccaacgtcgcccgaaacattggtatcgacaaagcatggtcaggtgcctacgcaccagcatcaaaagagacgcgcgcggcgctgatggttgagcgtattgaatcgttcaacagccccggttcactcagttattgcgagcagcgggacaagttcaacatgcagttacagctggctgtgtaggagaggttatgaaattacaactgccattcccgccgagtgttaacacctactggcgcgccccgaataaggggccgctggccgggcgccatctcatcagcgccgccgggcgcaaatatcagagcgatgcatgcgcggcgatcattgagcagttgcgccgcttaccgaagccgtccgcggaagccgctgcggttgaaatcatgctgtacccgccggacgcccgccgccgggacatcgacaactacaacaaagcgctgttcgacgcgctgacgcacgctggtgtctgggaggacgacagtcaggtaaaacgtatgctggtggagtgggggccagtgataaagaagggaagggtagaaatcacgatccgcaaatttgaaaccgtggcgagtgcagtcgccgaataagtggagaagagcatgaacgagttaatcaacgtaaccagcgcgctgacgatgtccagccgtgaaattgccgatctggtcgattcacgtcacagcaatgtacgcgtcacgattgaacgtctgatggcaaaaagcgttattgaggggtatacggcaatgcagtacacccatccgcagaacggccagcagtatcagtattacgaagtgagcaagcgcgacagctacatcatcgtggcgcagctctgccctgaattcaccgccaggctggttgatcgctggcaggcgctggagcatgcacagcaaattaacgtccctcagtcgctacctgatgcgcttcggctcgccgcggatctggctgagcaaaagcacaagctgacggcagagctggccgccgcggcgccgaaggtggagtttgtagatcgctactgtactgccagcggatccatgtcgttccgtcaggtggcgaaattgctcggtgccaaagagccagagttccgcctgttcctcatcgataacaacatcatgtaccggctggcgggcgcgctgacacctcatcatcagcatatcgatctcggtcggttcgaagttaaaaccggcacttcagcaaccaccaatcacgcattcagccaagcgcgctttacggcaaaaggcatcaagtggatcggcgggctttgggcggaacatctggcgaaaggaaaagctgcatgagggcactgctcaaaccggtcgttgtccgggagctgggtgtggtgatgttccgtcccggagcagagttgctggcgcacttcagccgcgggcgcatgttgctggagaacgaaccggaacgtctggccgggttaccgtccgggcaaatcccgcccgccgcgcagccgctggcagaagattcgatgctggtacccgtgtttgaaaacgagaaggtgatcgcgcgcgccggaggcatgttaggcctggaaaactggctgatgcgcggcggtgaatgtcagtatccgcacggcacttatcacatggaaaacgtgacggcatttcatcatgcacctggcgtgatccgcgtctgctggcactgcgataacacactgcgcggccagtctaccgagcgccttgcgggcattgcccgggcgaacctggcgcagtggatcattgagttcgtgcgaatggccctgggctttgatgatacccaccagctgacgatcccggaactgtgctggtggctggtgcgtaacgacctggctgacgtcatttccgaagatctggcgcgtcatgcattgcgcctgccggtggcaaccatttcgtcggtgtatcgcgaaagcgagctggtaccggcaccggcggccaccagcagcattgaggaaaaggcgaagcaggtgctggcgttgcgcatcgatccggaatcgccggaatcctttatgcgacgccctaagcgtaagcgctgggagaacgagaaatacaccaggtgggtaaaggcgcagccttgcgcctgctgtagcagccctgctgacgatccccatcacgtcattggctacggtcagggcggcatgggaaccaaagcgcatgacctgttcgtgataccgctgtgcagagcgcatcacgacgagttgcacactgacatgaaggcgtttgagaaaaaatattgcacgcagcccgagctgctgctgaagacattagaccgcgcgctggcgatcggcgtactggcgtaatttagtggagaaaaatgatgcgtgatattcagaaggtactggaattatggggcgggtgggccgccaacgatagcgcaggcgtagattattctcccatcgctgctggctttaaggggcttttaccccaaacaggcaagtcgaggctttcatgtactgatgacgatgctttaattatagagggatgtcttacgcgcctaaaaaagaggaagccaaacgagcattcgcttttagttgcacattacctttacggcatgtccaagcgtaagattgcaaaggcactcaaaaaggatgaaaagttaattagagtcgagatacaaatggctgagggatttgttgaggggtgtttatcatttcttgaggtacagcttgatatggacattcatcttaataaataatattttttaactagtaaggcgataatttgtatcgccttactagttggtatattaagaaaatgttgtagggtaaatctttaataagttgactttgtattgcattgccagatcacttacttcttgtgcattgatagagttcatatatggattaattaaatactcatcaatgtctgaatctttgtttctcgatttattaacatctactactgacgcaacatcatccattaactccaaagcataaataaattctttaacgtttgcatcgtcttttctaacagtaaatactatcccttgtggtttaagaagttttgattttttataaaaattcttagatagactaactgaactctcagcgatatttctctttgctaaatcagatataagagactcaaggctatccagtctatgcattaaaaccttttcgatagatgggatttctgttgactcattgataagaatggaattagcaaccctatatatagggttatcactaactaattcttttgttgcctcttcaattgctaccttcaatcttggaactagctcaaaagcccctgccatgtcgttgcgataaaatattgctctttcatcggaaatgtcgaatggtagaactgtaccttcttcagcaattgttactacaggtttacgtacggcatgtctaacagctaattcatacattacgtttggatttaactcagttaaatttgtaataactaagtcatcttttagtaaatgctctatcacctgtttagtgatagaccctagggaagatatttcatgcgcaacatgcaccttataccctttttcgattaacacaggcctaataacagtatcaagaataccctgtgcttttcttcgagtttgtgaatcagaatttccaataggtgttacaacgaaacaatgcttctcagtgtccatcttctgcttagtctcatttaatcatgaagtcataaaagttgtttgctacgttacgatagattgctaaaaaaaacactaatgcggtccgcaaaaattggattagtatgttaagaatgcttacttagtcacgttacttactcagtaaaacctcgctttcacgtggctttataattgatatgtctattaaaatcataaacttatcagcataagcatgatgtgcggttcgcttctaatatcagcatgccagtaattaaggcagtagtgtcaggctcacttcggtgggccttttttatttcccctcatctgagaggatccacatcagtgacgagggtctaaatgtccgaacctgtatccgggtctgttgcagctgcgagtgcgttaactggtgccagcctttacgggatgctgaccggcactgattatggtgtcgtgtttggcgcgttcgccggtgccgttttctacgtggccaccgcagcagatctaactattattcgccgatctgcatacttcatcgtttcctattttgcaggagtatatggttcggggttagtgggctcctggctcgccagcatgaccagttacaacgacaagccgcttgatgcactgggcgcggtgctcctgtccgccgttgctatcaagacactcacgtttttcagtgagcaggatccgctgacgcttctgcagaggtggagaggaggaaccaatggtaataagtgatcctctggtgctgaccaacgtaatgacatgcaccgcgattgttctgcgcctgatgatgttccgtaagccgggcggcaaacataactggtgggcgtcttggctggcgtacctgatcatcctggcgtatgcctctgtaccgttccgcttcctgttcgatttctatttccacgcccactgggcaaccgtcactatcaacttaatcatctgcgccgccgtgttcagggcacggggtaatgtggcgcggctgttctacgttctgaggccagagtgatgcagacattaaatacgcagcgcaaagcatttctggatatgctggcctggtcagaaggcaccgacaagcctggacagcccacccgcaatcgtggttatgacgtgattgtgggtggtacgctgtttaccagctatgccgatcacccccgcaaactggttacgcttaacccgaaactaaaatccacggccgccggtcgctatcagctcctgtcccgctactgggatgtgtaccgcatacagctcggcctgaaggatttctcccctgccagccaggatgcagtggcactgcagcaaataaaagagcgtggagcactaccgctcattgataagggtgacattcggcaggccatcgaccgttgcagcaatatctgggcatctcttcccggggcgggttacggccagtttgaacataaggttgataatctgatcgccaggttcaaagctgctggtggcaaagtcagcgagccaacatcatgatcgaaaccttcacagcgctggggaaaaaactctggttacccctgctggttgccgcagtgataggtgcacaggcgttcttcgttaaccactaccgcgataacgctgttacctacaaagatcagcgtgacaaggccaccagcgcgctgaacctggcgaaagaaacgattaccgacatgcagacgcgccagcgtgaagtggccgctttggatgccaaatacacaagagaactggcaaatgctcagaaaactatcgatcagcttgagcttgatgttgctgctgggcgtaagcggctgcggctcaacgcaaaatgtcccgcgaacggagaggccagcacctccagcgtggatgatggctccggccccagacttacagactccgctgaacggaattattacacccttcggcgacgaatcgaaaccatcaccaaccagataaccggcctgcaggcgtatgtgcgtgagcaatgccttagttgacttcataaaatagttacacaaaagcatattttttgatcttacagcataaatagatttctcattctgccgatattaaaagtttgaatctggcaaagggggcattatgcgttgcgttaattgtggttcagatcgtgtcgatacaaaaaattatggtaaaaaagttggtacaggtataggaactgctgctggtgctgtgggcggatacgctggagcgacttcgggagcgtctgctggcgcagcattcggcgcggcactaggctcatttgtgcctgttgttggcaatcttgtcggtgcagctgctggtggaatcgccggtgggattcttggggctcttggaggaggtgctcttggagctaaaacgggctcattggctggagaaatggtagataaaaatctcctggataattatgtttgtttagcatgtggccattcgttttcctcctgaagctaataactgcttttcaccaacgagattataaaaatttataccgcctccgggcggtttttttattgccgttaccatggatagttccatcgtaatgactacagaaggtaaaccgtgaatatatcctataagggataaagcctagcctcgcctctgcggggttttttattatctaatggagctgaaatgaagaaatatttagttgctttgctatgtgttgtgtctgcatcctcatttgcggaaacatataaaaattaccctgagattcctgctccggctgtaggttttgccacggaggtaattagctatcaacccggtccaaatgtggccgctggacgagacgatccgaaactggttttgggtgctccggcattttatagccctggcaaggcaccattttcactgggaacaggtggaaatgtcgttcttggtttcagcccggatgctattaagaaaagtggcactccagacgcggatttttatatctatgaagtcggtcagtatgagtcttgggatgcatacctatctaacgatggtacgaactggatcaaggctacagcctctttcagtaacgtgaacccgcagccggcctcctccacttccttcactcgcgggtctgtgattggttacgacgtcgacttgatcagtggtacagccgattcttttcgttatgtgaagatcgttgatacaagtctgtctacgtatgcaggctctggtggctcggacattgacgcagtcgtagtgaccagcgctaaggccttaggtcacgatgtgctggttgataccgattctcgaaacggtaaggtttataacctttatcagaatgatgttaccggggagatcggcgttaaaattatctacaaagacagcaaagtcacatacgtgccgttctcaactgacaattcgctcaaagcgatcgcactgtcattacaaggggacttcaactgtgacgatgaaaaagacatcaacgttctcgccacgcgctcgaatgataatgtgcaggtcaacattctcaaacagcaagatggaacgtcgattaaaaccattgataacgatgtaacaaagtaagaaattacagcagtcatgcattacgttgttatgaagtaatatagcccatctagagatgggctatatattttaaaggctgatgattttttgctctgataagttaaccagtaacaattcaagaatgcttttacctttataatcattatcagcttggcaaatagattttggttcgtatacgttctgaactataaacccatcatcagtaatgtaaattttaagtacggtctgtttttcataacgactcaggtcgatataaaattcaatttcgttgcaataagatgggtttcgctcaagatcgaaaattttcaatttggtctggatgtctatggtaaaaccaaagtcggagaattctaaatatttccgccttccatcaaaattaggtgtaattagttcgtttaaataagatacggatttaatataggcagagatgtttttgaataccgattcgacagagcggtcaatgctacgaagatcactttcaatagtggctaagagatgtgaaatggtaccaatccgattcatagtcattccttgtgtttgatggttgtgagcttgatgctcagaattttatataacatttcaagtgagtattctatgcccagtgcaattcctcgagcatgtcgcaaacgtggctgccctaaaacaactactgaccgctctggctactgtgatgcgcacataaatgaaggctggcatcagcatcagcgtggattgagccgtcaccagcgtggttacggcagcaattgggaaaacatccgggagcgtattcttaagcgtgatcgtcatctgtgccagaactgtctgcgtaatggcaggccgtgtccggctacaacagttgaccacattcaatctaaggctcataggggaagcgatgaggacagcaatcttgaaagcctttgctggtcctgccacagagcaaagacggcacgcgagcgcctcaagtgagagtcaatatcattcagggggaggggggttaaaagttcaggctcctgcctgcaaaggaccgccgcctaaccttttttcacaccgccgcaggttagaaaacttttttatggggatccccaccatcgattaataggagttttcgattatgcccggaccaccgaaaaccccgacacacctggctctggtgaaggggaacccatcaaaacgagcgatcaataaaaacgagcctaagcctcctgcaggggtacccccaactccgaagcatttcgataaacagggcaagtactggtttaagcgaatggctgatgagctggacgccataggcgtgattacccagcttgacgcgcgcgcgcttgaactgctggttgaggcgtataccgaatatcggcagcactgcgaaacgctggagattgagggttacacataccggactgaaactcagactggtgatgtactgattaaagcccacccggcggcaatcatgaaatctgacgcctggaagcggatccgcgccatgctgggtgaattcggaatgacgcctgccacccgaaccaaggtaggtggaaatggcccggctgaggccgatcctctggaagaatttcttaaaaagcgcaaatgatgaatggcaacggtttcggaaggtattcagtacgccgagcgcgtgctgtctggcgagattgttgctggcgaactggtacgcctggcgtgccagcgattccttaatgacttagagcatgggcctgagcgcggcatctacttcagcgaggaacgcgcccagcacatactcgatttttataacttcgttccccatgtgaaaggggcgctggcaggcaagccaatcactctgatggcctggcatgtttttatcctcatcaatatttttggtttcgtcgttcctttaatcgatgaaatgacagggcaggcggtggttgatgaagacggtgacactgtcatggtgcgccggttccgcacggcttatgacgaggtggcgcgtaaaaacgcaaagtccacactttcgtcaggcattggattgtacatgaccggcgccgacggcgagggtggtgctgaggtttactcagccgccacgacccgtgatcaggcgcggattgtttttgatgatgccaagaacatgatcaagaaagccccccgcacgctggggcgtctttttggtcacgttaagctgaacattcatcaggagcgcacggcctcaaagtttgagcccttgtccagcgatgctaacaacctcgacggcctgaacattcattgtggcattgtcgacgagctgcatgctcaccgtacccgtgatgtatgggacgttctggagaccgccaccggcgcacgccttcagtcactgcttttcgcaataacgacggcgggaaccaataaagagggcatctgttacgagcagcgggattatgccatcaaggtgttgcgcggcgtggtggaagatgacacttactttgctctgatctataccctggacgaaggtgacgatccctttgacgaggccaactggccgaaagctaatcccggcctcggtatttgtaagcgctgggacgacatgcgccgccttgccaaaaaggcgaaagagcaggtcgcggcgaggccgaacttctttaccaaacacctgaacatctggttaacagctgagagcgcctggatggatatggaccgctgggcaaaaatgcctggtattgccccggaagctgagcgcaaggcttggccactctgggttggtgtcgacctcgccaacaaaatcgatatttgcgccgcagttaaagcctggcgcgatcccgctggtgaaactcacatgcagccgcgtttctggatcccggaaggtcgactggaaacagcgcctgcacatatcgccgagctctacaggaagtgggcagccgccgggtatcttgaactgactgacggggatgttatcgatcacgggatgattaaagccgacattgtacagtgggtgaaaggcgagaacatcaaggagattgctttcgatccctggagcgccgttcagttcagcctgtcacttgcggaggaaggtttgccgctggttgaggttgctcagacggtcaaaaacctttctgagtccatgaaatcagtgcaggcggaaatttacggcaacaagttccaccacgacgataaccctgtgatgcggtggatgatgtcgaacgtcacggttaagccggacaaaaacgacaacatcttcccgaacaaatccacacctgaaaacaaaattgacggaccggtcgcactgtttacggccaaaagccggatgctggtcaatggcggtaatgacgctcaggatctgagcggcttctttgaaaatccaatcatggtaggtttctgatgaagaaaagtaagcagccgggaaaggtgaaaagcgccttgctcaactggctgggcgtgcctatcagcctgactaccggaacgttctggcaggagtggtacggcacgagcagcagcggcaagttggttacggcagataaggcgatacggctgtcagcggtctggtcctgtgtccggctcttgagcgagtcggtttctacattacccgtcaagatctatacccggcaggctgatggctcgcgcaagctggcgcaggatcatcctgtttatcaggtgctgtgccgccgcccgaatctggaaatgacgccgtcccgatttatgttgatggtggtggccagcatctgccttcgcggcaatgcctttgtcgagaagctgtttatcggcaataagctggtgtcgctggtgccactgctgccccagaacatggtagtaaagcggctggacaccggtcgtcttgagtacacctataccgaagacggcaggaaacgcgttattccggagaagaatttgatgcacatccgggggtttggcctcgatggtgtgtgcggcatgatgccaatgatgacgggccgggacgtgatcggcgcggcgatggccgtcgaagagtcagccgccaagatcttcgaaaatggcctgcagagttctggttttctttctgctgatgctgcgcttgataaggagcaaagagagcgacttcggggatatatgcaggccttcaccggctctaaaaacgccgggaaaattatggttctagaaggcggtcttaaataccagaacgtcaccatgaacccggaagcagcgcagatgctggaatcaagatcgttcagtatcgaggaaatctgtcgttggttccgcgtgccaccgtttatggttggccacacctcgaaacagagcagctgggcgtcgagcctggaggggatgaacctgcagttcctgacccatacgctgcgcccgctgctggtgaatatcgagcaggagatctcccgctgcctgcttaacggcgaagaagacctctttgccgagttctcagtagaagggctgctgcgcgccgatagtgctggccgtgcagcgtactataccagtgcgctgcagaacggctggatgtcccgcaacgacgtgcgccgtctggagaatatgccacctatcgaaggcggcgatatttacacggtgcagctaaacctgacgccgcttgaagatttgaaacaaaacagccaggccgcgcaggcatttgcgctacggcaggttcataaccacgtattccctgatattcccttcgaacagtcaccgctaaaaaaagcggcttaggagcatccatgacaattaaaagccttccggctgcgccggaggggcgaccttttgcgcgcgaaaaacctgatctgccagctgcggcaatggagcgctggaatggtggcattcgcgccgcccgcgaaggtgacaacagcatttctatcttcgacgtgatcggcgctgattactggggcgagggcgtgaccgccagccgcattgcaggggcgcttcgttcgctcggaggcgctgacgtgacggtcaatatcaacagccctggcggcgacatgttcgaggggctggccatatacaacctgctgcgcgagtacgaaggcaaagtaaccgtgaaggtgcttggcctagctgcatctgcggcatcgattatcgcgatggctggcgacgacgtgcagattggccgcggcgcgttcctgatgatccacaactgctgggtctatgcaatgggcaaccgtcacgacctggcgcagatcgccgctgacatggagccatttgataaagcgatgagcgatatctaccaggcgcgaagcggtcttgatgccgacaccgtcgacaggatgatggacggcgaaacctatatcggcggcagtgacgcggtggcgaagggatttgctgacagtctgctctcagctgacgagatagctgacgatgacgacagcccggcggcggccctgcgcaaactcgatgcgctgctggctaaaaccgatacgccgcgttctgagcgtcgaaaacttcttaaagcactatccggaagcaagccaggcgctgctgccaaccctgacggtacgccgagcgctgccaccatcgaaaacgaaactattgaccgactggaagccgcactcagcggcctgaaagcggctgcccagtaaaacggagaaattatgtctgatgtaaatgagatcctgaagaaagttagcgccagcattgaagaggcgaccggcaaattcaatgcaaaggcagaagaggcgctaaaagaagcaaagaaaaacggccagctgtcagcggaaaccaaagacaccgtcgataaaatggcagtggaatttaatgccctgaaagaggctgaaaaaacgctgaaggcggcgctcggcgaactggagcagcaggttgctcagatgccgctggcgaatgctgcaacggtgatcgagaccgtcggccagaccgtaatcagcagcgaagcactaaaagcgttcgcggcaagcgtggaaggcggtaagcgcgtcagcgtgccggtaaatgctgcgctgatctccactgacgtggcaagcggagtggttgagccgcagcgcctgccaggcattgataccgcgccgaagcagcgactcttcatccgggatctgattgcgccgggccgcacctctgcaccggccatcttctgggtgcagcagactggcttcactaatgcggcgaaggttgtgcctgaaggtaccgccaagccgtacagcgatatccagttcgccacgcagatcactcctgtaaccaccatcgcgcacatgttcaaagcgtccaagcagatcctggatgactttgcgcaactgcagtccactatcgacgctgagatgcgttatggcctgaaatacgtcgaagagcaggaaattctcttcggtgacggtaccggcgcgcacctgaaaggcatcgtgccgcaggcttctgcatacgatgcagccttcacggttgagcagcagaacggtattgacgatctgcgtctggccatgctgcaggcgcagctggcgcgcttcccggcttccggccacgtcctgcacttcatcgactgggcgaagattgaactcaccaaagacacgctgggccgctacatcctggcgaacccggcggcactgaccggtcctaccctgtggggcctgccggttgtggccactgaggccgcagcattccagggcaagttcctgaccggtgcgtttaacgcagcggcacagctgttcgatcgtgaagatgccaacgtggttatctccaccgagaacgccgacgacttcgagaaaaatatgatctcgattcgttgcgaagagcgcctggcgctggccgtgaaacgtccggaagcgtttatctacggttccttcaccgcgcctgctgctggcggcggtgcgtaaaccttaacggcggcctgcgggccgcttttctttttccttaaaggagacagccatgaagctgattgctatcaagcccatctactttgaaggcaaagtgcttactgaaggcaacgagtttgagactctggagcaacacggccgcgacctactggccagcggttacgctcaggagcctggcgagaagaagccggatccggataaagagcaaaagccgaaagggaatggcaaggccaaataaggagcgggcatgctgaccaaagagcaggttaaaacacactgccggatcgacgccgacagcaccgcagaagatatctggatcgaaaccagcatcaaagcggccgccctttacgttcagaagtggacccgacgccgtctttacgaaaatgcagctgatccactgtacctgcttgacccggatgcgctgctttacggcgaagatatcgaaatggccatgctgatgcttatcgcgcactggtacgcgaaccgggaagcggtcatcaccagtggcacctcttcaaccgttgatctggccgttgaatcgttgcttcaaccgtaccgcatttatggtgtctgagaggaatttatggcctgctccggatgcgccgcgcggcgtgaatggcttaaaaagtggatgaaaatcgcctatgaacgatcaacaggtaaaccagttgctgacagcaatggcagcccagacagcagcgatgaaccgactggcggagtcaaacgaggctctgacggcggtgatctaccagtcaatggtagtggaagagagtgatgctgagcttccgcagcatacttacctcagcggcaagcccagggggtaatcatgcaggcggggaagctcaataaacgaatcacgcttcagaaaccagttaaaacgcagagtccagttaccggcgcggtggttaatgggtgggctgaccaggccgagctgtgggctaacgttaccgatttgtctgcgcgcgattttgtggccgcgcaggcgggacagagcgagttaaccacacggatcactattcgctggcgtgatgatgtcacggataagcaccgcattcgttaccgcgggcgcgtttacgatattcagggcgtactggaagacgataaaagcggccgggagtatctgacgctaccctgctcaagaggggttaacgatggctgacggcgttgatttcagcattattggcgttgaggctttgctcggtaagctgtcatcggtcagtgacgatctgcgtcgtcgtggcggccgggctgcgctccggcgcgccggtaacgtgattgttgaaaaagcgaaagcgaatgccgccaggattgatgacccgttaacaggccgcaacattgctgccaacgtggcgatgcgctggaacggccgcctcttcaaaaccaccggcaatctgggttttcggatcggcgttcttcacggtgcagtcctgaaaaaaaatcctgatctcggtgagaatgcgccgacgccacactggcgtctgatcgagttcggtaccgagaatgtgcgggcgcagccgtttatgcgcccggcggccgaaagcagcgtcggtgaggtggttaacgtgtttgccacagaatacgaaaaggctattgaccgtgccctcaagcgcgcggcgaaaaagggagtgccaccatgatcgcccccatatttaccgtctgcgctgccagcccgtcggtggtggcattgctgggcggtgaaacgctgcgcctctatccgttcggccagcaggacgacaatgtggtctatccgtacgtggtgtggcagaacgtcaccggatctccggagaactacctggcccagcgtcccgacgcagactccttcaccctgcaggtggatgcgtatgccgacacggtggatgaggtgatcgccgtcgccgctgcactgcgcgatgccatagagccgcacgcacacatcacacgctggggcgggcaggagaaagaccccgaaaccagacgctatcgctattcgttcgacgttgactggatagtgaagcgataaccctctcaccggccctgagccggtttttttatgaccggagataaaccatgtctgtattaacgcaaggcacgcagctctttgtgcttactaaaggcgcagtgagtgaagtcgaatgcatcaccgctttttcgcctggcagcaaccctgccgatcagatcgaagacacctgtctttctgaaaagaacgatcgtacgtacaagcgcggtctgcgcacgccgggccaggcatcactgacgcttaatgccgatcccaaaaacgtcagtcatatcatgctctacaacctgtccatttctgatgatgaagaagaccaggagctgacatttgcgatcggctggtctgacggggaatcttcgccgacggcggcggcatccggcaccgccggggcagttgatggtctggttctgccggacgatcgcacctggtttgtgttcaagggctacgtaagcgacttcccgtttgattttgcagccaatacggttgtttccacttctgcctctatccagcgttccggctctgccgtctggataccaaaagcgagcgcctaacgcatgaagctgacacttgatgcactgaagcaggcgggggcctttactggccgcccggttgagaaagaaattacctggaaacagggcgacgagcagatcaccgccaccgtctatattcgccccatgggctaccattcagcaatgaccgacgttatggcggctaatggccgggtggatggcgtagccgggcgtattgctgcctctatctgcgacgaagccgggcttccggtatttaccccggcggatattaccggcgaagcggatccggaacgtggtgcgctggatggccccctgactatcgctctgctgcttgccatccaggaggttaacgatctgggaaagagtaccagctcagcgccgaagacgagttctggtgcgagctcgtccttaacggcatcggtggtagaaccatcgccgaagcgcgggaagcgatcagcttcaaagagtcgcagctctgggcaaaataccgggaaagatacggcagcctgaacccgatgatgcggactgagtggggcgctgcgctgatctcctcagtgctagctaacgtcaacaaaggcaaggacgctgcggcatttcgtatcagtgattttgcgccccacatagccgaaacgcccctctctctggaagatgctatgaatgactggaattgataagccaggttgaagttttgtcatcgctcagttccctgttattctttcaaaatcagtgaaaggaggggtgatggcgcttattaaatgtaaggaatgtggtgaggcagtatcaagcaaggcagatgtttgccctaaatgcggggcaccttttaagttaagggtaaaaggtccttcaggatgcatgatgatattgttggttatgattggggttgtttttactttctatttcatagcgaagatgagctaagttaataattgatattaatttgttttgctatgaattaataatttaatcatgcgaatgcaaatatacccgctccggcgggtttttcattttagggctttatatggctggaaaatcactcggcacactaactattgatttaatagcaaaggttggcggattcgtagcgggtatggataaagccgagagatcctcagccaagtggagacggcagattgaaagtgacgctaaggcggcgggttcggctatcctgtcagttggtacggttgccgctggcgcagctgtagcaacagcatctgctggaattgtcctcttaaaaacaatgtccaatcaggtaattgagaccgatcgctgggctaagtccttgaagctttccactcaggaattattagcttggcaatttgctgcgcaaaaagcaggggtttcaggtgaccagatggccgatatcttcaaagatattggagataagattggtgacgcagttttaaataagtcaggagaggcggttgacgccttgaatgctcttggcttatccgctttaaagctttcaaaaataacgccagacaaacaattattagcaataggggaggcgctaagcaagatcgggactaatgctgaaaaaacaacaatattagaaagcattggcaatgacctctctaaattacttcctttatttgataacaacaatcaaaaacttcagcagtttatccaattagcaaaagattatggcgtagccccttctccagaatcaattgatgatcttgttaaagtgaacaatctttttcaagatatggaggcgcaagccagcggcctgaaaatggaaattgctgctggactcgcaaaggtagatttatcacctcttcaaaacggtttggatgacttaaagaaaacgttcacagacccaaaagtgttgcagggtttagctgaaatggtcggtgggattgcgtctttagttgggtggatgggtaaggctgcttcagaattagggcggctggtggagaatttccaaggcggccaacgtgttgctgccaatgcttctcgcagtgaaattgaaagacgaattaaaaaccttgaatcagaccttaacgatcaagggtttcttgctggcgtaaaccgcgtcggaatggacactgaagccaagcagaaagagctaaaagaattacgtgagcgtctggctgatgttaaaaatttccagacttcactaccgactagtccagcaacattcatcgctccagtaagtagtgtttatgcacttggtaatggcgaaactaatggaaagcaaactgcggatgctggtgctaaaaagctagaaaacgccttcaaggctacagagcaaagttaccttcgccagatttcgctgatcgacacaaccggtaaaaaatcagccgaagtgaccgagcagcagaagcttcagtttgatatcgccgatggcaaactgtccgggcttaacgacacacagcgccagcgccttgaacttctggcaacagaagttgatcgcctgaatggagtgaagaaggccaatgaggaaaacctgaaggtcgctcaatatgtggctaatcttcagcgagaaaatgctaactctgcagcttcgttaaatgcggatattgtcggagctgggcagggcgacaaagtgcgggagcgcctgcgtgaacggctggatgtggagcgtgagttcaacgaaaagcgggccgatcttcagcagcgttaccagagtggggacattaaaagccaggtagaatacgatcgctataccgccgagcttgaaaaggcgctttcacagcggctggaaggatatgaaggctactatcagcagattgatcggcttaatgcagactgggtaaccggcgcgcgtgacggacttgctaactgggttgatgactccacaaattatgcttcactggctgcaggcgccatgcaaagcgctatgtccgggatcagcagcaatattgtcgacatgcttaacgacaacaaggccagctggaaagactggggtgtcagtgtgctcaaggtgattgagcaggtaatggttaacatggcaatagccagtgctgttagctcaattggctccctgttcagtttcggggcctcatctgccagctcgactccctcaggagcatacaactcagccgcggcgggaattaagctcaatgctaaaggtggcgtttatgactcagcagatctcagcaagttcagtaatagcatcgtaagcagcccgaccatgtttgcgttcgccaaaggtgctggtctgatgggcgaggccgggccggaggctatcatgccacttacccgtgcatctgatggatcgctcggcgtccgggctctgggcgcagtgggtggtggtggcacgatgttcaacattaatgcccctgtctctatcacccagggtgattcgggtgacgaggtgaataacgcaagcacagccagcaccgccagacagcttgaaggtattgtgcagaagaccctgactgatcgcctgcggaaagaaatatcgccaggcggtatcctttatcgccggacgtgatgttccggttcatttcggaaaacatatggcaatcgatacgtttatctggtgcgttcgcaccgatgcaagtggctcaacgaatgtggccacgctgcaggcacagtttggggatggctataaacaggttgccagcgccgggattaacacggctgccgaaacatggaatttagcgtgtagcgggaaattggcagccatgaagccggtgcgggagtttcttcttagccatgtcatcaagtctttctggtgggtgaatccatggggggagaaaaaactttaccgcgtcaaagctgattctgtcagtcccacattcccgaatggtggttttgttgaaatatcgtttgtatttgagcaggccttcgcgccgtaaattccccgattcattcgataacaggccgcttatgcggccttttttatgggtcttatatgagtttttcaggtgacatccagcaactggagccgggccagcttatccggctaattgaaattgacggtacagctttcggcatagataccgtgctgcgctttcacgcgcacaacattgatccggcaggctgggctgcattcgccgctgataatcttcccgccatcatctggcagggccagcagtacgatccgtacccgtacgagctaaagggcatggagttgtccagcaccggtgcacagccgacgcccacgctatccgtgtcgaatatcggcaactacgtcaccgcgctgtgtctggaatacgacgacatggtcaaagcaaaggtgaaaatacacaccaccctggcgaaatacctcgatgctgcaaactgggtagcgggcaacttgaacgccagcccggcagatgagcgggtgcagctgttttacgtcaacgccaagaccgctgaaacacggatgcaggtagatttcgagctgtgttcacccttcgatgttcagaacctgcaactacccacccggcaaattacgcctgtctgcacctggtgcatgcggggctggtaccgaaccggcaacggctgcgattacgccggaaaccggtattttctgaaagacggcacaccaacgaacaatccggcgctggacgtctgcggtggtcggctgcctgactgtgaagccaggttcggggaaggtaatccgttatcgttcggcggattcccggcggcaaaccttcaggggaaataagcatgcgcaaaaagttaatgaaagccattgctgatcatgtagcagcggaatatccgaatgaagcgtgtggcgtcgtggtgcagtccggacgggcgcagaactacattccgtgtcgcaacattgcaaaaaacccggcggaggccttcacgctggcgccggaagacaggcttgcggcagaggagcagggtgaaatcatcatgatcgttcattctcacccggacgtagtgcaactggtgccgtccgagcacgatcgtatccagtgcgactggtccggcgtggagtgggggatcatgtcctggcctgacggggatttctgcacgctctcgccaagagaagaccgggattataccgggcggcgctgggtgctcggctttgcagactgctggtcgcttatccgtgagtggtaccagcgtgagcacggcgttgccctgggcaattactcggtgccgtatgaatggtgggaacagggcgaaaaccgctacgacgataactggcaggctgagggttttttcgaagttgacccgacggatattcgccccggcgacatgatcatgatgcgcgtacaggcgcaggtgaccaatcatgccgcggtatacctcggcgacaatctcatcctgcatcatatcaccgggcaactttcggcccgggtgccatacggaaaatattaccgcgaccgcaccgttcgggtggtgcgtcataaggagctgataaatgctgaaaatgctcattcttgacgggcgcatggcgaagaaattcgggcgcgtacacaaatttgacgtggcggatctgccagaaatgctgcgcgcgatgtgcagccaggtgcggggatttaagcgctacctgtcagaggggcatatgcatggaattcgcttcgccttcttcaacggtaagcacaatatcggccttgatgaattcgatatgactaatggatcggaggtgtaccggattacgtccatcaccgaaggttcaaagcgcggtggcgtattgcagattgtcatcggtgcggttgcgctggtggcagccttctttaccgcaggcggcagtcttgtcgcacttggcatgagcgcagccgctgccgcagcgaccacgacagcgttaaccggccttggtctgagcatgatgcttggaggcgtggttcagctgctcaccccgcaaccaaaatacaatgtcggcgcatcttccagcacggacaataaacccaactatgcattcggcgcgccggtgaacaccgtggcaatgggctacccggtcccggtgcttttcggtgagcgtgagattggcggggccattatcagtgcggggattttctccagcgatcagcaataacaacaggtgagatatgcgtttactggaaaacgaaaccattcagggcaggaagggcggcgggggcggtaaacagcatacgccagttgagcagccggatgatctgctgtcggatgcgaaactcaaaatgctggtcgtgctgtctgaaggtgaaattcagggcgacctgaccgcgcagaagatttacctgaacgatacggcgctggcgaacgacgacggcagctataacttcaccggcgttaaatgggagtaccgtaagggtacacaggaccagccttatatccagggattgccggaagtggataacgagctgtcagctaacgtggcggtgaccaccaccgtcccatggacccgccagttcagcaatcttacccttgatgccgtgcgcatcaaactcagcctgcccgcacagtacatgtacaaagacaatggcgatatggtcggcaccgtcacgcagtacgccattgacctgtccaccgatggcgcagcatggcgcaccgtagtagacgggaaatttgacggcaaaaccacctctgaatatcagcgcgatcatcgtatcgatctcccggaggcaacaacaggctggtcaatcagagtgcgccgcatcacagcagactccacgtccgcgaaactggtgaacggcttcaaggtcttctcttttgcagaagtgatcgacagcaaacttcgttatccgaacagcgctctgctttatatcgaggtcgacagcagccagttttccggcggcgcgccgaaagtaacgtgcaggcctaagggtaaattaatccgcgttccggacacttacgatccggttacccgcacctatagcgggacgtggtctggcggttttaagctggcctacaccaacaacccggcgtggattttctatgatctggtgctggataaaatttacggcatgggtaaccgcgtcgatgccagcatgattgataagtgggcactttatgccatttctcagtattgcgatgagaaggtgtcgaatggcgccggtggcacagaacctcgcttcacctgcaacgtgttcatccagagccagcaggatgcctataccgtactgagcgatctggccgctgtgttccgggggataaccttctggggaaacgatcagatattcgtgcgcgcggacgtaccgcaggacgatgtggattttgtttaccacgcctcaaatgtgattgacggtctgttcacctacggcagcggcagttataagaaccgctattcatcagcactggtatcctggtcagatccgcagaaccattacagcgacaccgtagaaggcgtgtatgacgaaaaactggttgagcgttacaacgtaaaccagatgtcgcttacggcgattggctgcacgtcacagagtgaggcgcaccgccggggccgctgggctattctctcgaacgcgcgcgacggtaccatttctttcggggtagggcttgatggctacattccgttaccggcggagatcatcggtgtggctgacccgttccgcgccggtaaacagaacggcggccgcatcagcgcggtcagtggccgaaacattacccttgaccgggccgttgactacgcagcaggtgaccggctggtggttaacctgcctgacgggtcggcgcagacccgcaccattggcgctgtcagcagtgacaagaaaacggtgaccgtgaatactgcattcagccagccaccggcggcgggtgcggtgtgggccatcgacagtgacagcctggcgattcagtatttccgtgtgacctccatcagtgcgaacgatgacagtaacggcggctttaccattactgccgtacagcacgacccgaacaaataccggtacatcgatgatggtgtgcgcatcgacccggcgccgatcaccgtcaccccgatcagcgtaatatccgcaccgaaaaacatcatcatcacagaggtggatcatgttgcccaggggctgaacgttgcgacgatgaatgtcacctgggacaaggtgggtggcgctattcgctatatggcccagtggcgcaaggataacggggactggatcaacgtcgccgtcaccagtgcgcagggcttttcaattcagggcatttataccggcagctatgacgttcgcgttcgcgccatgaatgcccaggagtcttcttctccatggggctacgctgatactacttatctgaccgggaaaaccggtaagccaggcacaccgcagaatcttctggcaacggatgatgttgtgtgggcgattgatgtaacgtggtccttcccggatggatcgggtgacacgtcctataccgagctgcagcgcgccacgacggacgacaaagccaaccctgagctgctggcgctggtgccatacccggcagtcagttaccagcacggccccatgcctgccggtgtccgacaatggtaccgcgcgcgcctcgttgaccgtattggaaatgtgggggactggactgcctgggttatgggcacctcttccattgatgtcagtgccatcaccgatgacattctgaatgacatgaaagaatcggaagtatttaagaacctgattgagaacgccgtagacagcaatgaaactattgccggaatggtgacagatattcaggaaaacgccgatcagcttgagcaacaggcgttacaaatccagcaaaactccgatggcctttcacaggcagccgtaaaaatcgacgaaatttccgtttcgatggacggcatgactggcggtgtcaaaaactcatcaattgccgtgatccagaacaccctggcgcaggtgacttcccgcagatcccagactgccaccaataacggtaatgtggcaaaaattgaccggatagacaccaccatagcggataccagccaggctgttgcccgggcgctggttacgcttgatgcgtctgcgggtgggaatgtttcgaacgcgaccgatctgacggaaacgctggctgacttcacccaggcatccgccacgaagattaactctctgacggtgacagtgaacgggcagacggctgccatcaaccagacggcgcaggcggtggcagatgtaaacggcaacctaaacgcgatgtacaacatcaaagttggcgttgccgctaacggccagtattacgctgcaggtatgggcataggggtacaaaatacacccggcggcatgcaatcacaggtaatttttctggcagaccgttttgctgttaccacgcaggccggtgccgttgtatcgctgccattcgtgattcagaacgggcaaacctttatccgtgagaccttcattcaggacggcacgatcaccaatgcgaaaattggcgcatacattcagtcatcaaactatgtcgtcggtaccttgggatggcggatagataagaacgggaccatcgagataaacggtggggtagcaggccagggcaggctggttattacaaataaccggatcatttcgtatgaccagtacggtcgcctggcagccgttatggggcagagagtgtaatgcagacatttatcgctggaaccagctttgatgccatcaactcgatggcggtcaactatgtgatggacgttatcgacatctccggatcgggaagcagaacttacccggccgggtgtacttaccaggccagcctgataatcgaaacggctgtttccgcgcttcccaccaataacccgtatcaggtaaccgtgtccgggaatatcgtttcatggagcgtggcgactccggtccgactggtcgtgctggctacgccaaatactggtaccgacagcagctatttcggccagtcgctgtattcatatgacgcctatggtaacaagacggtaaagctggctccggatttcgtcccgttctgtctggttgacgtcatagacgtgccgcccggtggccagcttattcagacacggatccctgtcagcaataaaatcgtcacgtttcaccggctgccaaacgccgacgggcggttatcgacatccgtttattcggtggtgaattccggtgggtatcatgcattctcgttcaatgcctccggaataaaccaaaccgggtgccgaatttacgttttctcaaactatctggtgaacatcccggattggggatttttcgtttaccgggacgggacgctggtctggcacagtaactgcctgccgctcaatatggggctgatgaccggcgatcttgaatcggcaacgccactggcggtgacaccaggcgtgacatccgtcgtctttatacccgcggatccggcatcgccaaaaagcggcggctatctgaactccagttgttctgccgccggatataaaaacggggtgtggcaggcgacgatagcgaacgtgttttcaagccgcataatctcaggacaagaggccgatgcagtaaagccatgggctattcgtggctatgtcggttacatagactgcagtatctacgaccagtactacccctatgcgctcgggctggtttaatccgtcttacacaacattgcatatacaacccgcttcggcgggttttttattgcccggagaaaatatgatctataacgcaggtacaatctctttcaatggtaattctgtcacaggcacgggcacgaacttcaccgcgccgaccagtcagatccgcatagggcagactttgctggtggcatcaaatccggtgcagctcgttcagataacggccattaacagcgccacttccctgaccgttacgcctgcagcatcaccggctgttagcggccagcgttacggtattctggttacggacagcctgtcagttgatggccttgcccaaagcatctcccagcttattaacgaatatgatgaaaatatcggagcctgggaggcctttgccactacgaacgccaaccagaatgtaacagtcaccatcaacggccagagcgtaatcattcctgcgatgggtaagttgctgcaaaaagggagcaatggcgcgctggcagttaaagacggcggtaccggttcaagtgatgcggcaggcgctcgcacaaacctcggtttaggaaaagcagatggtgtgactttcacgaacctggatctgagtcttaaagggggtagctcaggcatcttgaccctgaaccagttagcaactgattcaaccttttccggtgggagtcggtt

SEQ ID NO: 3 - DNA, 594014 bp, Enterobacter sp SA187
tttgcctggcggcactagcgcggcggtcccacctgaccccatgccgaactcagaagtgaaacgccgtagcgccgatggtagtgtggggtctccccatgcgagagtagggaactgccaggcatcaaataaagcagaaggccatcctcacggatggcctttttgcgtttttatccttcctgatcctgcccacgcatttcatcaatctcgtctaaaatagtcctgtgccattcatccggaggacgttttttgcctaacccgcctttcaactaccaacaggatttcaacagcatcgatttccgcgcgcatccggagctgtaccaggttggccgcggcgagcagggcgtattgcttgtcgagccttataaaagtgagatcctcccgctctggcgctttaaaacccctgaaatagccgcgttgtctgcgcagcaaatcatggaaaagttcgaggagtaccgtcagcaggacgattttgtcggcatggatatggcccgcaaatttattcagatgggctatacccgcgccagacgctacgctaatcaccccggcggaagaaaatacgatgaagataaaaacgttctgccgcgccagaacgaccccataaaagccgaagccgcgaccatcttcaaaaaatactgggataacctgcgcgctgacgaagactatctgcgacgcaaaaaagcccatcagcaaaaatacggctgatcgccagacgcttattccaaacgctacctgaaaatttctcaactggcatatgcaggctcgacatttctgccattcctggttattgtcagctgtctggatgtctaaacgtttatacgtatgctttgaggatttaaggttatgccgattcgggtacaggacgagctgccagccgtcaatttcttacgtgatgaaaacgtcttcgtcatgacgacatcccgtgcaacaggtcaggagatccgcccgctgaaggtgctgatcctcaatctgatgccaaagaaaatcgaaacggaaaaccagttcctgcgattgctgtcgaactccccgctacaggtggatattcagctgctgcgcattgattcccgcgaatcccgcaatacgccagcggaacatctgaacaacttttactgtaacttcgaagatatctgtaatgataacttcgatggcctgatcgtcaccggcgcgccgctgggcctggtggagtttaatgacgttgcctactggccgcagatcaaacaggtgctggaatgggccaaagatcatgttacttcaacgctgtttgtctgttgggcagtgcaggcggcgctcaatatcctctatggcattcccaagcagacccgcaaagacaaactctctggcgtgtatgaacaccatatcacccaaccccatgccttgctcacccgtggttttgatgatgtctttctggcgccgcactcccgctttgccgacttcccggcggcgctgatccgtgactataccgatctggagatcttcgctgaaaccgccaatggcgacgcctatctgttcggcagtaaagacaaacgtattgctttcgttaccggacatcctgaatacgatgctgatacgcttgccggcgagtatttccgcgacgtggaagccgggctgaaccccgacgtgccgtacaactattttccgggcaacgatccgcagcatgtgccgcgcgccagctggcgcagccacggtaatttgctgttcaccaactggctcaactactacgtttaccagatcacgccgttcgatctgcgccatatgaaccccacgctggattaagcgtttcagctcctcttaaagcacctgcgggtgctttttttatttctgaaaaacacttcccggcacgattaaattttaatctgtttgttatcaattggttaatatattattaattaaaaaatggaaattgtttttgattttgtgttttcgttgagtaatcttaaacctgctgaacgaaaactgcacagtctgaatttcatcagcgatgaggatcattctggatcaacaacgaggagccatggcatgacacaacaggcaaccacgactgaagaactggccttcagtcaaccgcatagcgggcaggagcagcagatcctgacgcccgaagcggtggagtttctcagtgaactggtggcgcgctttacgcccaaacgcaacgccctgctggcagcaaggctgcaacagcagctgaaaatagataacggtacgctgcccgattttatttcggaaactgcttccattcgtgaaagcgactggaagatccgcggcatcccggcggatttacgtaacagacgcgttgagatcaccgggccggtcgagcgcaaaatggtgattaacgccctcaacgccaatgtgaatgtcttcatggcggactttgaggactcgctggcgcccaactggcaaaaagtgatcgaaggccagatcaacctgcgtgacgcggttaacggcaccatcagttacaccaatgaaagcgggaaaatctatcagctgaaacccgatcctgcggtgctgttttgccgtgtgcgcggtcttcatctgccggaaaaacacgttacctggcgcggtgagccgatccccggcagcctgttcgacttcgcgctctacttcttccacaaccataaaaacctgctcgccaaaggcagcggcccctatttctatctgccgaaaacccaggcctggcaggaagccgcatggtggagcgaggtattcagctatgccgaagatcgcttcaacctgccgcgcggcaccattaaagccacgctgctgattgaaaccctgcccgcggttttccagatggacgagatcctgcacgcgctgcgcgatcatatcgtcggcctgaactgtggccgctgggattacatcttcagctatatcaaaacgctgaagaactatccggatcgtgtgctgccggatcgtcagcaggtgacgatgaataagccattccttaatgcctactcgcgtctgctgattaaaacctgtcaccgtcgcggcgcctttgcgatgggcggcatggccgcgttcattccgagtaaagatcgtgaacgcaatgagtgggtgctgaacaaagtcaaagccgacaaagagctggaagctaaaaacggtcacgacggcacctggatcgcgcatcccggtctggctgatacggtgatggacatcttcaaccatgcgctgggcgataaccccaaccaactgcacgtcacccgcgacgaagatgcgcctgttaccgccgacgaactgctggccccctgtgacggcgagcgtaccgaagagggcatgcgcgccaatatccgcgtggcggtgcagtacatcgaagcctggatctccggcaatggctgcgtgccgatttatggcctgatggaagacgctgcaacggcagaaatctcgcgcacctcaatctggcagtggatccatcacgaaaaatcgctcagtgacggcacgcccgtcaccaaagcgctgttccgccgcatgctggcggaagagatgcaggtgatccaggaagaactgggtgaacaccggttcagcagcgggcgcttcagcgatgccgcgcgcctgatggagcaaatcaccacctccgacgagctgatcgacttcctgactctgccgggctaccgcctgctggcgtgatccccacataataaaaatggagcatctgcgatgaaaacccgtacccaacaaatcgaacaactacaacaagaatggactaacccgcgctgggagggcatccgtcgcccgtacagcgccgatgaagtggtgaagctgcgcggctcggtgaatccggagtgcacgctcgctcagctgggagccgccagaatgtggcgactactgcacggcgagtcgaaaaaaggctatatcaacagtctcggcgcgctgaccggcggtcaggcattgcaacaggcgaaggcggggatcgaagcgatttatctctccggctggcaggtggcggccgatgctaacctcgcgtccagcatgtatccggatcaatccctctatccggcgaactccgtacccgcggtggtggatcggatcaacaatacctttcgccgcgcggatcagatccagtgggcggcaggcatcgaaccgggggatccgcgctatgtggattacttcctgccgatcgttgctgatgccgaagccggtttcggcggcgtgcttaacgcgttcgaactgatgaagtcgatgatcgctgcgggcgcggcggccgtgcattttgaagatcagctcgcctcggtgaaaaaatgcggccatatgggcggcaaagtgctggtgccgacgcaggaagccattcagaaactggtagcggcgcgtctggcggctgacgtgatgggcgtcccgacgttgctcatcgcccgtaccgatgctgacgcggccgatctcatcacctccgattgcgatgaatatgaccgtgaatttattaccggtgaacgcaccagcgaaggcttttaccgcacacgggcaggtattgaacaggcgatcagccgcggccttgcttacgccccttatgccgatctggtgtggtgcgaaacttcgacgccggatctggagcaggcgaagcgttttgccgacgccattcacgcccgcttccccggcaaactgctggcctataactgctcgccgtcgttcaactggcagaaaaatctcgacgacaccaccatcgccagcttccagcagcagctggcggagatgggctacaaataccagttcatcaccctcgccggcatccacagcatgtggttcaacatgttcgacctggcccatgcttacgcgcagggcgagggcatgaagcattatgttgaaaaggtccagcagccggaattcgccgctgcgaaagagggttacacctttgtgtctcatcagcaggaagtgggtaccggttacttcgacaaggtgacgaccattattcagggcggcacctcctccgttaccgcgctgaccggttcgacggaagaacagcagttctgacgtcctgtagcccggtggcgcgaggcttaccgggcctgcggatcctgtcgttgtgcaggccggataagcgaagcgccatccggcaatcccaatttcggacgagggcaaaagatgtcccgtgacctggaactgttaatcgcccagaccattctccagggttttgacgcgcagtatgggcgcttcctggaggtcacctccggcgcgcagcagcgctttgagcaggcggactggcacgccgtgcaacaggcgatgaaaagccgtatccatctctacgatcatcacgtcgggctggtggtcgagcagttacgctgcattaccgataaccagacgctcagcgccggatttctgctgcgcgtcaaagagcagtacaccgccttgctgcctgattatccgcgtttcgaaatcgccgaaagcttctttaattctgtctactgccgcctgttcagtcaccgtcagctgacgcccgaacggctgtttgtgttcagctcacagcccgcgcagcgcctgcacgttacgccgcggccgctggcgaaagactttacgccgtattacggctggcacgcgctgctccataacgtgctggaagatctacccctgcggctgccgtggcaggatcaggcgcgtgatgtgggttatatcgtggcgcatctgctggaaaatttcggtgaagcgcggttacgtcaggcgcgtttgcagatcgccaacgaactgttttatcgcaacaaggccgcgtggctggtgggaaagctgatcctgcctgacgccaccgtgccctttttactgccgatccaccgcgcggacgatcaccggctgttcgttgatacctgcctgaccaccagcgccgaagccagcatcgtctttggcttcgcccgctcctactttatggtttacgccccttttcccggcgcgctggtggaatggctgcgggagatcctgcccggtaaaaccaccgctgagctgtatatggcgattggctgccagaaacatggcaaaaccgaaagctatcgggaatatctgcactatatcgctgacagcgacgagcagtttgttgaagcgcctggcattcgcggcatggtgatgctggtgttcaccctgccgggattcgatcgggtgtttaaggtcattaaagatcgcttcgcgccgcaaaaggagatggacgccgcccatgtgcgcgcctgctaccagctggtcaaggagcacgatcgcgtcggacgcatggccgacacccaggagtttgaaaattttgtgctggagaagcggcggatcgctccggcgctgatgacgctgctgatggaggaagcgccgggcaaaatcaccgaccagggggataatatcgccatcagtcatctctatattgaacggcgcatggtgccgctgaatatctggctggagcaggtggacggtcaggcgttgcacgacgccatcgaagagtacggtaacgccatccgccagctggccgccgccaatattttccccggcgatatgctgtttaaaaacttcggcgtaacgcgccacgggcgggtggtgttctatgactacgatgaaatttgctatatgacggaggtgaatttccgcgacattccgcccgcccgttatccggaagatgagatgagcgctgagccatggtacagcgtggcgccgggggacgtattcccggaggagttccgccactggctgtgcgccgatccgcgctgccgggtgctgtttgaagaattgcacgccgatctctttcgcgcggagtactggcgcgggttacaggaacgcattcggcagggctatatagaagacgtttacgcctaccgccgtcgccagcgtttcagccagcgttacggggcggggtgacaggccgggtattatgcaattgtggtatttgtaggccgggtaaggcgtagccgccacccggcatctcttggttgcaacaccacattaccgtgtgccgccgtacgccagcgtcacttctttcgccgctttgatcaccagcgcgcccagctccgtcacgcggtcatcggtaatgcgcgaaatcggcccggaaatggagatcgccgcaaaaggttcgcgatgctcatcataaatacaggccgccacacagcgcaggccgagtgcgtgctcttcatcatccagggagtaaccgcgcttgcgcgtctgggccagatcttctttcagatgcagcggcgacaccagggtcgcatgagtatatgcatgcagcccctggcgatgcagcagcccggtgacctgctcttcagaaagctgcgccagaaaggctttccccgcgccggacgcatgcatcggcagcttaccgccgatcggcgctgacatgcgcattaactgcgtgcactgtacctgatcgataataattgcctgatgatcgctctggtcgagcaccgccagattcaccgtctcgccggagtcttccatcagcttgcgcagaatgggatgcacaatcgccagcagattacggctttgcaaaaaactgctgccgataacgaacgcgtgtgcgcctacagcccagtgccccagctcacccacctgacgcacaaagcccagctgctgcatggtggtcagcaggcggtgcgtcgtggagttcggcaggccagcctgctgcgccagctcggtcagcgccacgctgccgtgggattcagcgatccactccagcaacttcaggccgcgcgtcagcgactgcacctggccggtggcctgttgtgcagcggcgggggcgggttttcttccgcgtttggcgggaacagtggcaaccatagctgactccttttctgtatcgtggaaatcattttcgttttatttgattatattgcaaccatcctcttactgatcggaggagtggttatgaacatgtctcatgttcagcgctgttctcttttccgccacaggggattgtgccagtatggtctgctggcctttctggcctggttgagcgtcgtcaggagcactcgtgagcagcaaagttgagcaactgcatcagcagttaaaaaaacgcattctggttctggacgggggcatgggcaccatgatccagggctatcgtctgagtgagcaggatttccgcggcgaacgtttcgccgactggccctgcgatctgaaaggtaacaatgacctgctggtgctgagcaaaccggaggtgatcaccgccatccacaacgcctattttgaggcgggcgcggacatcattgaaaccaacacctttaactccacgacaatcgccatggcggattaccagatggaatccctgtcggcggagatcaaccgcgaggcggcgaaactggcccgcgcctgtgccgatgaatggacagcccgcacgcctgacaggccccgctatgtggcgggcgtgctcggcccgaccaaccgcacggcgtctatttcgccgaacgtcaacgatccggcgttccgtaacatcactttcgatcagcttgtcgaggcctaccgggaatcgacccatgcgctggtggagggcggcagcgacctgatcctcatcgaaaccgtgttcgacaccctgaacgccaaagcagcgattttcgcggtgaaagccgaattcgacgcgctgggcattgagctgccgatcatgatttccggcaccattaccgacgcctccgggcgcacgctgtccgggcagaccaccgaagccttctataactcgctgcgccacgccgatgcgctcaccttcggcctcaactgtgcgcttggcccggatgaactgcgtcagtacgtgcaggagctgtcgcgcatcgcggagtgctacgtcaccgctcacccgaacgccgggctgccgaatgccttcggcgaatacgatctcgacgccgacaccatggccacgcagatccgtgaatgggccgaagcgggctttctgaatatcgtcggcggctgctgcggcaccaccccggaacacattgccgccatggatcgcgcggtggcgggattagcgccgcgcgccataccggagttgccggtagcctgtcgccttgccgggctggagccgctgaacatcggtgccgacagcctgtttgtgaacgtcggcgagcgtaccaacgtcaccggctctgccaaattcaagcgcctgatcaaagaagaaaaatataacgaagcgctggaagttgccctgcaacaggtggagagcggcgcgcaaattatcgacattaatatggatgaggggatgctcgacgccgaagcggcgatggtgcgtttccttaacctgatcgccggcgagccggacatcgcccgcgtgccgatcatgatcgactcctccaaatgggaggtgatcgaaaaaggcctgaaatgcattcagggcaaaggcatcgttaactccatctccatgaaagagggcgtcgaggcctttattcatcatgcgaaactggtgcggcgctacggcgcggcgatggtggtgatggcgttcgatgaagtcggccaggccgacacccgcgcgcgtaaaatcgaaatctgccgccgggcctacaaaattcttaccgaagaggtgggtttcccgccggaagacatcatttttgacccgaatatcttcgccgtcgccaccggcatcgaagagcacaacaactacgcgcaggactttatcggcgcctgcgaagacattaaacgcgaactgccgcacgcgatgatttccggcggcgtgtcgaacgtctccttctccttccgtggcaacgatccggtgcgtgaagccattcacgccgtattcctctattacgccatccgcaacggcatggacatgggcatcgttaacgccggacagctggcgatttatgacgatctgcccgctgaactgcgcgacgcggtggaagacgtggtgcttaaccgccgcgacgacggcactgagcgtctgctggatctggcggaaaaataccgcggcagcaaagccgacgacggcgcgaacgcgcagcaggccgagtggcgcagctgggacgtgcgtaaacgtctcgaatactcgctggtcaagggcatcacggagtttatcgaggcggataccgaagaagcccgccagcaggccgaacgccccatccaggtgattgaaggtccgctgatggacggcatgaacgtggttggcgatctgtttggcgaagggaaaatgttcctgccgcaggtggtgaaatccgcccgcgtcatgaaacaggcggtggcctggctggagccgtacatcgaagccagcaaagagaaaggcaaaaccaacggcaaaatggtgatcgccaccgtgaagggcgacgtacacgacatcggcaaaaatatcgtcggcgtggtgttgcagtgtaataactatgagattgtcgatctgggcgtgatggtaccggcagagaagatcctcaaaaccgcccgtgaagtgaatgccgatctgattggtctgtccggcctgatcacgccgtcgctggacgaaatggtcaacgtggcgaaagagatggagcgccagggctttaccattccgctgctgattggcggcgccaccacctccaaagcgcacaccgcggtgaagatcgagcagaactacagcggcccgacggtctacgtgcaaaacgcctcgcgcaccgtgggcgtggtgtctgcgctgctgtccgacgatcagcacgacgattttgtcgcccgtacccgcaaagagtacgaaaccgtacgcattcagcatgggcgtaaaaaaccgcgtaccccaccggtgacgttacaggcggcgcgggaaaacgatctggctttcgactgggagagctataccccgccagtagtgcatcgtcccggcgtacaggaagtcagcgccagcattgagacactgcgtaactacatcgactggacgccgttctttatgacctggtcgctggccggaaaatacccgcgcattctcgaagatgaggtggtgggggaagaggcgcagcgcctgtttaaagacgccaacgacctgctggataaactgagcgccgaaaaatcgctcaatccgcgcggcgtggtcgggctgttcccggcgaaccgggtgggcgatgacgtggaaatttaccgtgacgagtcccgcacgcaggtgctgaccgtggcgcaccatctgcgtcagcagaccgagaagatcggctttgccaactactgcctcgctgatttcgtcgccccgaaactcagcggtaaagcggattatatcggcgccttcgcggtgaccggtggcctcgaggaagacgcgctggccgaggcctacgacgcgcagcacgatgattacaacaaaatcatggtcaaggccgtcgccgaccgtctggcggaagcctttgccgaatacctgcacgagcgggtgcgcaaagtgtactggggctacgcgccgaacgagaacctcagcaacgaggagctgatccgcgagaactaccaggggatccgcccggcaccggggtatccggcctgcccggagcacaccgaaaaaggtaccatctggcaactgttggacgtggaaacccacaccggtatgaagctgacggaatccttcgccatgtggccgggcgcgtcggtatcgggctggtacttcagccatcctgacagcaaatactttgccgtggcgcagatccagcgcgaccaggtggaagactacgccctgcgcaaagggatgacggtaacggaagtggagcgctggctggccccgcatctgggttacgacgcggattaaccctgtcatatttggttaataataaacaaggcaccttccgggtgccttggcactttattacatttaagaccttatacttacctgagtgaactcacctttccccacgggagaagaggaggagaaaggaaaccaacaatactcaggaggcaaccattccgtgttaacgctgttacacctgttatccgctgtcgccctgctggtctggggaacccatatcgtgcgcaccggcgtcatgcgcgtgttcggcgcgcggctgcgtaccgtactcagccgcagcgtggaaaagaaaccgctcgccttctgcgcggggattggcgtcaccgcgctggtacagagcagtaacgccaccactctgctggtgacctctttcgtcgcccaggatctggtggcgctggccccggcgctggtgattgtgctgggcgcggatgtcggtacggcgctgatggcgcgcgtgctgacctttgatctttcatggctgtcgccgctgctgatatttatcggcgtgattttcttccttggccgcaaacagacgcgcgccggacagatggggcgcgtgggtattggcctcgggcttattctgctggcgctggagctgatcgtacaggcggtgacgcccatcacccaggccaacggtgtaaaagtgatttttgcctcgctgacgggcgatctgatgctggatgcgctgataggcgcaatgtttgcagtgatcacctattccagtctggcggcggtgctgctgaccgccacgctgacggcggcgggggtgatcgctttcccggtcgcgctctgtctggtcattggcgcaaacctcggctccggcctgcttgcggtactcaataacagcgctgctaatgccgccgcccgccgggtggcgatgggcagcctgctgtttaagctggtgggcagcctggcgatcctgccgtttgtgcatctgctggctgatgccatggaccggctgccgctgccggagtccgagctggtgatctatttccacgttttctacaacctgatccgctgcctggtgatggtgccttttgtcgggccgatggcgaatttctgtaagcgtattattcgtgatgagccggagctggatgcgcgcttaaaaccgaagcatctggataccagtgcgctggacacccccgcgctggcgctgtccaatgccgcgcgcgaaacgctgcgcatgggcgacgccatggagcagatgctggtggatttcaaaaaggtgatgcacggcgagccgcgtcaggaaaaagagctgcgtaaaacggcggatgacatcaacgtgctttacaccgccatcaaactctatctggcgcgtatgccgaaggatgaactggcggaagaggagtcccgccgctgggcggaaattattgaaatgtcccttaacctcgaacaggcgtcagacattgtcgagcggatgggtagcgaaatcgctgataaatccctctccgcacggcgggcgttttcgctggaaggcttaaacgaactggacgcgctgctggagcagttgctcagcaacctgcaactggcgatgtcggtattcttttccggcgatgtgcccagcgcccgccgcctgcgccgccgcaaacaccgtttccgcatcctcaaccggcgctactctcatgcgcacgttgatcggctgcatcagcaaaacgtgcagagtatcgaaaccagttcgctgcatctggggctgttaggcgacatgaaacgtctgaattcgcttttctgcgcggtggcctacagcgtgatggaacaaccggatgaagacgacgagcgcgacgagtattaatattttctctgtgccggatagccatgctgtcctgctcagccaaagagttcactgtgcgtaccgagatcgataaaggtgaccaggttttgggtgtcatcaagccggtaaaccagcaggaaatcacccccgatatgtaactctctggcgcctgcccattccgccccgttcagttcatgatccagatattcagcaggcaatgtggtctgacagaaaatgagtgacatcacgtctgcaacatcatgcatattacgtcggccagctttgttgtaacgtgcccaggactttgcaaaagtgcgggtatattccacccggcgagggagtttacttctcttgtgattcatcgtcgttcagtcccttgagcatatcgtccatcgacgtaaagcgatgacttgctttcgtttcgatctccgttgcttcctgcaacgcgattttcattctggcagaaggtcgcttaacctcaaacgggatgccctgatggctgaccacctgttcaaggaaaaggcgaacggcgctgcttaccgtaagtccacagtcgcgtaatacctgactcgcttcatttttcagctcctcagaaatacgcattttaatgctggtttgcataaatctattctccacaaagttgtgggtacattgtgggggcgcagcgcttatttttcaagcattgctctgctaacgagaaacctgtgacctcacaaagccattttttctgacgcggcaggtaaggtatattccgcttttacaggagaatttatgctgccagactcatcaacccgattaaacaaatacattagcgaaagcgggatctgctcgcgtcgcgaggctgaccgttacatcgagcagggaaacgtctttattaacggcaaacgcgccgctattggcgaccaggtctctcccggcgatgtggtaaaagttaacggtcagttgattgagccgcgggaagcggaagatttggtgtttatcgcgctgaacaaacccgtgggtatcgtcagcaccacggaagacagcgaaaaagacaacattgtggatttcgtgaaccacagtaagcgcgttttccccatcgggcgtctggataaagactcgcaggggctgattttcctcaccaaccacggcgatctggtgaataaaatcctgcgcgccggtaacgatcacgaaaaagagtatctggtgacggtcaacaaactggttaccgatgagtttattcgcggcatgggcgcaggcgtgccgatcctcggtacggtaaccaaaaagtgcaaagtcaaaaaggaagcgccctttaccttccgtattacgctggttcaggggctgaaccgtcagatccgccgcatgtgcgaacatttcggttatgaagtgacgaagctggagcgcacgcgcatcatgaacgtcagtctcagcggcttaccgcagggggagtggcgcgatctgacggacgatgagctgattggcctgtttaagctgattgaaaattccagttcggaagcaaagccgaaaggaaaagccaaaccgaagacccagtccgcgaaagcgcctgcggctaaagccgcgaagcccgacgacaaaagccgggcgaaacctgccggcaaacgcttcgtgcagccgggtcgtaagaaaaaagggcgctaaaccctaacgcttgccgcgcgtggaggtattggcagaccaggaataggtcgcctccgcgtccggtttataggctttttgcttcttcgcctgtcgcgcctttttggccgccgcttcacgctccgccatcagtttatcgatgtactcttttttcacatgattggtttcagaattggtgagcagacgcccgtgtgatatgcgtgcgcggtcgagcagtgttttcagctcgcgctgttcactttccgtcatatcttgttgtgtcagtcttgcaatagccatggtgacgatctcctggggaaagtgccacgagtgtacgtgatgaacgcgatccatgcagtaaccttcgtcgcacaaaaaaatgccgggtaaaaacccggcagcaaggcgtgataaacgacagcagcactcttactcaaacaaattgtgatgcagtttctgcacgacctgctcagcctcgccgcccggcaccaggaagcacaggttatggctggatgcgccatagcaaatcatgcggatattgaacggctccagcacgccaaacacctctttgcccacgccgcaggctttcgacagatcgttgccgatcagcgctaccagcgcgagattttcttccacttccacgcggcacagggcagacagctccatcagcagtgactgcgtcagcagcgtatcgccggtggaggtggagccggtggtgtccagcgtcagcgccacgctgacttcggaggtggtgatcaagtccacggaaatattgtgacgggcgagaatgccgaatacctccgccaggaaaccgcgggagtgcagcatgttcaggctgtgcagggtgaccagcgtctgcttacgacgcagcgccagcgcgcggaacagcggcgggttttgcgtttcattgcataccagcgtgccgcctgcctgcggatctttgcttgaaccgacaaacaccggtatatcgctgcgcacggcgggcagtaaggttgccgggtgcagcactttcgcgccgaacgtcgccatctcggcggcttcttcaaaggcgatttcgtcgatgcgttttgccgacggcaccacgcgcggatcggtggtgtaaatccctggtacgtcagtccagatgtcgacgcgggtggcgtgcagcgcttctgccagcagtgccgccgtgtaatcgctgccgccgcgaccaagcgtggtggtacggcctttggattcgctgccgataaagccctgggtgatcaccaggccttcttccagacgcggcgcaagctgttgtttcgccagctcggccagcgcggcgacgtccggctcggcacgaccaaagcggtcactggtgcgcatgattttacgcacgtcaaaccagcgggcgtcgacgttgcgctcacgcaggatctccacgaacagcagggtggacattaattcgccatggctgaccagttcatcggtcagcgcggtagaggtagccagcgacgccgcttccgccagcgtggtgatgttttccagcaggcggtcgatttcctcgcggatgacgttcggattgcgcatacgctccagaatgtcgaactggattttgcgaatggcgtccagcttcacgaagcgctcagtggcttcaagcccctctgccagcgccaccagcaggttggtgacgcccgctgacgctgagagcaccaccaggcgcacgctgtcgtcagagagcaccacatcggcgctgcggttcatggcatcaaaatcggcaacgctggtgccgccgaatttggcgacgatgagcggggatacagcttctgtcataacgacctcgtgtcagggagagaaaaagcgaccatggcacaagggcatatcgaaaaccggtgctggcgcaaataccgtatttataaataaaaggtgcggcgggcagtgtcaacgccgggattatgcggattattcatgttatccagccgcccaggaaattaacttataacggctatactttgcgcgggccttcctcttaacgcgacgatccccattacacaaaaaccatcacaatttttgtgcgcaggcgctacaatcgaccgcagttaacattctcaaatcagaagagtattgccatgaaaaacattaacccgaagcaaacttctgcctggcaggcactgcaaaaacactatgaggcgatgaaagatgtgaccatcgccgagctcttcgcgcaggacagcgatcgtttcgcgaagttctccgccacctttaacgatcagatgctggtggatttctccaaaaaccgcatcactgaagaaacgctctccctgttgcaggatctggccaaagaaaccgatctggccggcgccatcaaatccatgttctccggtgagaagatcaaccgcacggaagatcgcgcggtgctgcacgtcgcgctgcgtaaccgcagcaatacgccaattcttgttgacggcaaagatgtgatgccggaagtaaacgcagtgctggaaaaaatgaaagccttctcggaagcgatcatttccggtagctggaaaggctacaccggcaagccgatcaccgacgtggtgaacatcggtatcggcggctccgacctcggcccgttcatggtgaccgaagcgctgcgcccgtacaaaaaccacctcaacatgcactttgtctctaacgtcgatggcacccacatcgcggaagtgctgaagaaagtgaacccggaaagcacgctgttcctcgtggcgtccaaaaccttcaccacccaggaaaccatgaccaacgccctgagcgcgcgcgaatggttcctgaaaaccgccggcgatcagcagcacgttgcgaaacacttcgccgcgctctccaccaatgcgaaagcagtaggcgaatttggtattgataccgccaatatgttcgagttctgggactgggtgggcggccgttactccctgtggtcagcgattggtctgtcgatcatcctgtccgttggctttgacaactttgtggaactgctgtccggcgcgcacgcgatggataagcacttctccaccaccgcgccggagcaaaacctgccggtcctgctggcgctgatcggcatctggtacaacaacttcttcggcgctgaaaccgaagcgatcctgccgtacgaccagtacatgcaccgttttgccgcgtacttccagcagggcaacatggaatccaacggtaagtatgttgaccgtaacggtaatccggtggactaccagactggcccgatcatctggggtgagccgggcaccaacggtcagcacgcgttctatcagctgatccaccagggaaccaaaatggtgccgtgcgatttcatcgccccggcgatcacccataacccgctgtccgatcaccatccgaagctgctgtctaacttcttcgcccagaccgaagcgctggcgtttggtaaatcccgtgacgtggttgagcaggaatatgccgaccagggtaaagatccgaagacgctggagcacgtggtgccgtttaaagtgttcgaaggcaaccgcccgaccaactccattctgctgcgtgaaatcacgccggcaagcctgggtgcgctgattgcgctctatgagcacaaaatcttcacccagggcgcgatccttaacatcttcacctttgaccagtggggcgtagagcttggtaagcagctggcgaaccgcatcctgccggagctgggcgatgaaaaagaaatcagcagccacgacagctcaaccaatggcctgatcaaccgctacaagtcctggcgtaaataaggcattgcaggcccgtgcaggcgtagcgtcgccgggctatttaaaaatttctatctatactaaaagccgatattagtatcggcttttcttatcggataattcccgttgtctgtgccttgccgcaaattcctgtattgagtttaatctgaaaatccagaatgacctgttattacctgagggttattttaggataatacgcagctaaaatcatcagtacctctattttatccttttgattttaaatatattaaaattaagtgaagcggtttgaccgcaggccattgtccaattatcttaaaaccctgtggctatttccctgctacgtaattcgcctgccttagttgtgtatactcgatcgcgcctgagtctctctcgggtaaaaaatccattcattcaatgaagggaaattgatatgcgtaaagtcctgtatggcatttttgccatttcagcgctggcggcgacgtctgcgtttgcggcaccggtgcaagtcggtgaagctgcagggtcggctgcaacgtcggtatcggcgggcagctcgtctgcgacaagcgtcagcaccgtgagttctgcggtgggtgtcgcgctcgcagcgaccggcggtggtgatggatccaataccggaaccaccactacaacgaccacaagtacccagtaatcgggggtacattaaccataaccacacttcggtgtggttattttgaccctggagaattgttgtgaagcgagccggaattgttctgctttgtctgttgcttcaggcgtgctccggcacgaccaaaggactgggaagcgcgctgtgggatagcatgttcggcacccctggcgtccatctcacggatgaagacatcgcggacatgccctacgcgagccagtacatgcagctcaacggcggaccgcagttatttgtggtgctggcgttctcagaaaacggccagctgaaatgggtgacgcaggatcaggccactatcgtgactcagcatgggcgcatcgttaagaccctgatcggccaggataaccttatcgaggtgaacaatctcgccgccgatccgctgaccaaacccaatcaggtgcgggacggcgcaagctggacgcggacgatgggctggacggaacacggccaggtgcgttacgccaccgcgcaatcgaccttccgctgggcgggcaccgacaccctcgcgcttggcagcgatgtcaccgacgtccgcgtgctggaagaagaagtgaccaccgatcaaaaaacatggactaaccgtttctggatagacagtgaagggcaaatcaggcagtcaacccagtatctgggcgctgattatttccccatcaacactatgttgattaaggctgcaaaagaaaaatgaaggcacttatcacatcgttacttttaaccctgatgcctccgctggcctttgctgcgggcactatcaaggtttattccccggacagcacacagccgaaaacattaaccgatgccccttttctgattgatttagtcgggcagccccggctggcaaacagctggtggccgggcgcggtgatcagcgaaggcaaagccacggtgattgccgaacagcgtcatcaggcgctgctggcgcgtcttggcgcgctggcgagtgaagaagagggcgacgatgccgccgcaatcaacagcgtgcgccgtcagttgcaggcggtgaaagtgaccggacgtcagctggtgccgctcgatccggatcgggtacgcgtcgaacctacggccaaccgtccgctggaaggtgagtacacactgtgggtggggccacagcctgctacggtgatggtcgcggggcttatcagcagccccggtaagaagccctttcagcccgggcgcgatgtggcgggctatcttgatgacatgagcctgctcagcggcgcggaacgtagctatgcgtgggtgatttatcccgacgggcgaaccgagaatgtgcctgtggcgtactggaaccggcggcatgttgagccgatgccgggcagcgtgatcctggtcggctttgccgactcgatctggagcagccagtacgaagaaattaacgccgatattctttactccctcacgcatcggatcccggattaatgaaaaaaatctatctctacagtctgctggcgctgggggtgaacgcggcgtgccatgcagaaacctatccggcccccattggcccgtcgcagtccgattttggcggcgttggcctgttacagacgcccacggcgcgcatggcgcgtgaaggcgagatcagcctcaactatcgcgataacgatcagtaccgctactattctggctcggtgcagcttttcccgtggctggaaaccactctgcgctacaccgacgtgcgtacccgtcagtacagcagcgtggatgcgttttccggcgaccagacttacaaagataaagccttcgatttaaaactgcgcctgtgggaagagggctactggctgccgcaggtggcggtgggcgcgcgcgatatcggcggtaccggcctgtttgacgccgaatacatcgtggcgaacaaagcctggggaccctttgatttctcgctcggcctcggctggggctatcttggcacctcgggcaacatcaaaaacccgctctgtacctacagcaataaatattgcgtacgcgataacagctacaatcaggccggctcggtggatgccagccagatgttccacggaccgacttcgctgttcggcggcgtagagtaccagacgccgtggcaaccgctgcgcctgaagctggaatatgaaggtaacaactacgagcaggacttcgcgggcaaactgccgcaacgcagcaacttcaacgtcggggcgatttatcgcgtcaccgactgggccgacgtcaacgtgagctatgagcgcggcaacaccttcatgtttggcgtcacgctgcgtaataactttaacgatttgcgcccaagctataacgataacgcccgtccgcaataccagccgcagccgcaggacgccatcctgcaacattctgtggtggcgaatcagctgacgctgctgaaatataacgcgggccttgcggatccgcagattcaggtgaaagacgataccctgtacgttaccggcgagcaggtgaaataccgcgactcgcaggaagggatcgagcgcgccaaccgcatcatcatgaacgatttgccggacggcattcgcaccatccgcgtgacggaaaatcgtctgaacatgccgcaggtgaccactgaaaccgacgtcgccagcctgcaacgccatttacagggcgagccgctgggacatgaaaccgaactggtgcaaaaacgtgttgagccggaggtgccggacaccaccgagcagggctggtatatcgaaaaatcccgtttcgattttcatatcgatccggtactcaaccagtccgtgggcggcccggaaagcttctacatgtaccagctgggcgtgatggcgactgccgatctgtggctgaccgaccacctgctgaccaccggcagtctgttcggcaacatcgccaacaactacgacaaattcaactacaccaacccgccgaaggattcgctgctgccgcgcgtgcgtacccatgtgcgtgattatgttgaaaacgactactacgttaacaacatgcaggccaactacttccagtatctcggcaacggcttctacggccaggtgtacggcggctatctggaaaccatgtacggcggcgcaggcgccgaagtgctgtggcgtccggtggacagcaactgggcgttcggcattgatgccaactacgtgaagcagcgtgactggcgcggtccgaaagagatgatgaaattcaccgattacagcgtgaaaaccggccatctcaccgcctactggacgccgccgttcgcgcaggatgtgctgatcaaggccagcgtcgggcagtatctggcaggcgataagggcggcaccctggaagtggcgaaacacttcgacagcggcgtcgtggtgggcacctatgccaccatcaccaacgtgtcgcctgaagagtacggcgaaggcgacttcaccaaaggcgtctatgtctcgataccgctggatctgttctcgaccggcccgacccgcagccgcgccggcatcggctggacaccgctgacgcgtgacggtggtcagatgctgggccgtaaattccagctgtatgatatgaccagcgatcgctccattaacttccgctgattccccccttaaattgtccctctcccgaccgggagagggcatttctctgtaactttaaaagaaatcctgcttttgtgatttacgtgattatgttcacaatgattaaacgtttaatcatttagcataagtggcgttcatggagttaattgataaacatgatgtcattcattgttaacgtatccacagggttggtgggcttttctatgaaaaaacaaaccattcatttctttcagatgttatcccgcgcttttattactcccgttgcgcttctgtcttttgcttcattgttgctgggcgtcgcctcgttgtttctctggcatgaaaaactacgtgaattgctgccgtttttaaattctgtcgtatttcagtatgtcgctaatctgcttaatactgtgggcgcggtaataatggataatttgcccttattatttgcagttacgctggcctttacgcttgcgaaagcagagaaagaatatgcggcgctgggcgcgctatgtggttatatggctttgctgatgggtatgcatgtgctgattacagtcaatcctgcggtcaacgagatgtttacgaaaagcgcgctgacgaccacgctgggtattgaaacagtcaacacgggcgtggtaggcggtattattaccggtctgctctccgcaataattcataatcgtgttcatcagataaaattcccggtggcgctggcttttttcggcggcgtcaggttcgtccccctcgccaatattatgtttttcgtggcctttggtcagtgctttccttttttatggttgatgctttccaaagtgataaaccatgcggcaatgggcatctccagcgcgggtgtttttgcgccctttatctatggtctgggagagcgattactcctgcccacaggactgcatcaaatctggaatacggtcatcagggatacgatggtttccggtatcgctatttttcctgacgggcacacggtggaaggcgcaagagcgatttttgcggaatacctgaaaaccaacaccctaccggtcaatatgacgctggcggacatcgttaaattcctgcgcggtgggcagatcccgataaccatgttcaccctgccgatgatggcgctggccatgtaccagacggcgaggccagagcagcgtaacaagatcaagccgttactggtgaccggcgcttttacctccattatcgccggtgtgactgaacctctggaattcacctttcttttcgtttcaccggtctggtatctgatctattccgtcattaacggcttaagctggatgttctgttatctcttccagagtaatttaggcggcaccgaagccaatattattgggctggtactctatggcttcctgcgcccggaatcgacattctggataaacatgttgattggcatcgtctttagtcttgcaggttatacgctgttccgcttctggatcgtgcattttgatttaaaaacgccgggccggggcagcgactatgaacagacgatcgatattctggggatcaatcagcaacaggatgacatatcaaacgatccgctaaaactaaaagcgttagcgataatccggggcttaggcggaaacaagaatattatcagcgtcgattgttgctatagccgcctgagggtaagcattcatgatatttcgctggtcgatgaacacattattcaggcaacgggcgcattaggttatgtgccggttgatgacggaaacgtgcaaattgtttacggcaccaccgtcgatactattcgtaacgcagtcaggaaattactttaaaggagcaatcatgcaaatccatctggtaaaagattataacgcgatgtcggcttgtgcgtttgacattattgccaatactcttcgccaaaaatccagcccggtgatctcgctgaccaccggcgcgacacctgccggactttttaaattgctggtgaaggcgattaatgctggcgacattgatatttcaaataccgttttcctgaatattgatgagtatgtcggtaaccagcgtgatgtgtataccgttcatacctttatgtttgaacgtctgtataaccagttgacgcaaaagcccaaatacttcgacatgtttaatgcaggtacccttaataaggactatgaaattctgcgttataaacacattctcgacacctatccgcgggatattcagttaatggggctgggcaccaacgggcacattggcgcctgcgagccgggcacgcccttcgatgccagcgcgttctgcgctgaacataaggcatcgacggttgaaagcaccatgaagctctacaacattacgcgcgaacaagcgccgactcacatgttcacgctgggcttcagggaaattatggctgccgacaggccgttgttgatcgtcagcggtaccagcaaagccgacgccgttcgccgtctgcttgaggagccgatcaatgagtcctgcccggcatcctttctgcgtaatcatcccaacttcactctcatccttgatgaagaggccgcctcacaactgcgtaaggaaacgctggaatgggcaacacgttaattgctacctggcgcatggcgctggaagggctggctgaagcggcagagataagtgatgtgaagaacgctgttctgcatgcggtccgtaaggttgaagacaatcccaggctgcattccgtcggctacggtggtttaccggcagaaaacggtgaggtcgagctggatgcagcctttatggatggcgatacgctaagctatggcgcggtggcggcggtacgcgatcttaaaaatcccattatggccgcgcattatcttagcggcctgcaacgcaataacgtgctctgcgggacgggggctttccatgtcgcggtcgggcagggaatggagacgcgggataacacttattcgctggcgcagcagaaatggcgcgccgcgctacaggcttcgcccggcccgctaccgctggaagcctacgatggtcacgatacggtgtgcattctgggacgcgcgcctggcgggtcggtttgcgctggcgtgtcgacctcgggattatttatgaaaaaaccggggcgcatgggggattcaccgattattggctccgggtgctacgccgatagcgcaacgggcgcggcggcggcaaccggcgtcggcgaggatattatgaaaggctgcctttcatgggaaatcgtccggctgatggagcagtactccccgcaggaagcctgcgacagagcgctcaaccagcataccgcaaagctgcttgcccgccgtggcgcctgcggcagcatgtccgtaattgcgcttaaccgcgaaggcgagtggggggcggctactaataaagatgaattttcttttgtcgttgccgaaccagggcgcgccgccgaagtctggctggcgcatcaccatcgtcattcccctgaacgtgcttccgcagagtggctgaacgggtggctggtaaatttgcatgcgggctgcggaggttaagccgaatccctgataattaatgccggatggaatgcttcgccctgcagtggttgtttatcgtcatccatatgacaaagtaacagcctggcggcgttccatcccatctgcgtcgctgaagtgtcgatacaggtaatagacggcgagaaaaattcggtgtcactgacgttttcgaggcaaataatggcgatatcacgattgatatagctgtcttttccgatgccccgtccacgcatttttatcgcggaaatcacttcctgcgtggtggccgcatcatagcaaatcatcgcggtgacccagggagaacgggaaaatagtgccgccattctgtctgctaatgcgccagcgttgctgtccgcaataatcagcgaagtatcttcctcaagattatgttcttttaacgccgcaaagtacccggccagtttctctgcgcgatctagcgatttgggatgtccgccgataaaggcgatatgcatatgcccgacattaatcaaatagcgggtggcgatatttccggcatagtgggcgttaagccctatctgttgaggttgttccgcgacccccgaggaggcgataaacagacagggaatattacgggcattcagacgggcaagggtacgctcattattgtcgcgttcactgacgatcaaaaagccgtcaacgttatagttcagcgcgatattaatgcggttttccagttcggcctgggtttcgaaaatcatgatgaaagagacttttttgtgttcatcaatacagctggtgatccctttcagggcatccacattaaaggcctggcccagaccgtgaaccagtacggcaataagccccgttttaccgcttttaagcgtggcggcattgttatttctgacgtaacccagttcatcaatagccttgttgatccgctccgtcgtccattttgagatacggcctttccccgagagcgccatcgatacggtcgccgcagaaacctctgccagcttcgctacatcggtgatcgtcggttttttccctgccatcctgtgtatttcctctcaaccgcaaggggatctattttacgttattggactgactttctcgccatgatgatccgccgccgtgctttcacttagaaagcataagtaaagaatgtagatccagatcacatttctgcgctatacagtaagctcgtcactgtaatgaggtgctgtatgacatcgctaagtcgtccccgcgttgagttcatctccaccattttgcagactgtgctcagtttaggtctgctcagccttggcctgatcttggtggtctttcttggcaaagagacgctgcatctggcagatgtgctttttgcgccggagcgcaccagcaaatatgagctggtagaagggctggtggtttattttctctacttcgaatttatcgcgctgatcgtgaaatactttcagtccggttatcactttccgctgcgctattttatctatatcggcattaccgccatcgtgcggctgatcatcgtcgatcataaatcgccgatggacgtgctgatctactccgcggcgatcctgctgctggtcctgacgttatggctgtgtaactcgaaacggctcaagcgcgaataaaaaaaggcggcctgcgggccgcctgacaatcaaaagtaacgcaacaatacaagttgaggataacagtggcatatcacgatgaaactcagcctttcaccccgcccgccgtcaggccattcaccagccagcgttgtgccagcaggaacaccacggtgatggggattgcagaaagtacagccgcagcggcaaagtcgccccacaggtagttttgcgggttgagatactgctgcataccgaccgccagcgtgtagctgttaacatcacgcagcaacagcgaggcgaccggaacttcggtaatagcggcgataaacgacagaataaacaccaccgccagaataggcacagagagcggcaacaacaccagacggaacgcctgccatggcgttgcgccatccagcgacgccgcttcttccagcgaaccatcaatggtttcaaaatagcctttaatcgtccacacatgcagcgcgatgccgcccagataggcgaagatcaccccgccgtgggtgttcagcccgataaacggaatgtactgcccgaggcggtcgaagagggcataaagcgccaccagcgacagcacagccgggaacatctggaaaatcagcatacttttcagcagcgtggctttgcccggaaaacgcatacgggcaaaagcgtaggcgcaggtggtggacagcgccacaatgccgatggcggtgatggccgcgattttgatcgagttccacagccataacagcaccgggaacggcggcggcgttacgcgaccatcggcgtgctcaatgctgaagccgagcgccagtttccagtgctcccaggaaatctgatccgggatcaggctgccggtggcgaagttgcccggacgcagcgaaatcgcgatgaccatcagtagcgggaacatgatcgcggcgataaaaattagcagcccgaggtgcgtgagcagaaggcgcagcttttgtgatttgggttgtaccatagccatttacagtgccctccttagtcaaatttcatgcgtgtggctttcaggttgatgatggcaagcgcccccaccagcaggaaaatcagcgtggcgatagccgccgccaggccaaagtcctgcccgccgccgccttcaaaggcgatgcgataggtatagctgaccagcaaatcggtatagcccgcaggcgtggtggtgccgagccggtccggcccgccattggttaacagctggatcagcacgaagttgttaaagttaaaggcaaagctggcgatcatcagcggcgtcagcggcttgatcagcagcgggaaggtgatcttaaagaagttctgcaaagggcttgcaccgtccatcgccgaagcctcataaagatcgtccgggatcgctttcagcaggcccatgcagaggatcatcatgtaggggtagccgagccaggtattgacgatcacgatcatcgcccgcgcggttgtcggatcgctgaaccaggccggacggatgccaaacagcccgctcagcatcatattgatctccccgaagctctggttgaacaggcctttgaagatcaggatcgagatgaacgacggtacggcgtagggcaggatcagcagcacgcgatacagcgctttgcctttgagggattcccactgcaccaggcaggccagtaccatgccgaccgctacggtcagtaccaccgtcaggagtgagaaaatcaccgtccagacgaaaatggcgaagaagggttgctgaatgccttcgtcggtaaagacgcgcataaagttcttccagccgatggtcacggtatagccggggctgagtttttcgtcgccccagttgccgtcagcgttaacggcctggaaataaccgatgtcattgttcgggcgatacaccacgccgctctgattattggtcagcgcgccgtcatcgccgcgcgtatacagcggacgggtgccggagaactggcgcagtgaactcatgatgactttgctgtcgtcgggcagcacagcggtcagctggttcagcgcctgacggttctgggtgatcacgcgcagattgccgcgttcgccttccggcagggcgggggcttctttcagcttcagcgtctgctcgccgccgaacctgaaggcgtctgagacataatttttgccgctttcaccgtcggtcagtgccaggatccagtcattacccgccgggtaaagtccaaaattaaatgactttccggcctgataaacgcgatccatcagcacctcttgcgcccgctcctgggtgagctggttggtgctgctgtagttggtgaaggcgatggcgatggtacagaccagcgggaacaatacgaacagccccatacccgccacgccaggataaacatagcgccaggcataggttttgcggttcgcgaaaatatacaggccagcagagcttaaaatcagcgtcatgatggcaaacaggtactccccctgggcgtacatcaaaaccacaagccaggccaccagcaggccgagcagggcgatggttgcccattttacggtctcgctttgccaccaatgactctttctaacgacatccatggggattcatcctctaccactgtgaaaacctgtaggccggataagacgcgtggcgtcgccatccggcaactgcgactgatggcgctgcgcttatcaggcctacatttattacttacttagttacacgggcctgtgcatctttcagcgcggcgtcaacggtctggcgaccgctggcagcgttgatcactgcggtgcgtacggcataccagaaggccgacatctgcggcacgttcggcatgatttcaccggtctgcgcgtttgccatggtggcggcaatgcgcggatccttcgctaactgatcctgataggatttcagggccaccgcgcctaacggcttgtctttgttcacttccgccaggccatcgtccgtcagcaggtagttttccaggaactctttcgccagttctttgttcgggctggcggcgttaatgcctgcgctcagtacgccaacgaacggcttagaggctttgcctttgaaggtcggcagcatggtcacgccgtagttcactttgctcttgtcgatgtttgcccatgcccacggcccgttgatggtcatcgcggtatcgcctttgttaaaggcggcttcggcgatggagtaatcggtatccgcgttcatgtgtttgtttttgatcagatccaccaggaaggtcagacccgctttcgcgcccgcgctgtcgacgccgacatctttcacgtcatacttgccgttttcatacttgtacgcatacccaccgtcggcggcgatcagcggccaggtgaagtacggctcctgaaggttgaacatcagcgcgctcttacctttcgccttcagctctttatccagcgccgggatctcttcccaggtttttggcgggttagggacgagatctttgttgtaaatcagggagagggcttcaacagaaatcgggtaggcgatgatcttgccgttgtaacgtaccgcatcccaggtgaacgggaagagtttgtcctggaaggctttgtccggggaaatttccgccagcaggccagactgcgcgtagccgccaaagcggtcgtgcgcccagaaaataatgtccgggccatcaccggtggccgccacctgtgggtatttctcttccagtttatccgggtgttcaacggtcactttgatgccagtgtctttctcgaattttttacccacttcggccaggccgttatagcctttatcgccgttgatccagataaccagcttaccttcttcaattttggcgagagccggtgcggtcagcatcatcgtcgcgatcgcggataatgccagaatgcctgcgccagttttgattttcataaatcccgtcctttttggtgatgtgctctcacgatgtcgaacacaggtacacagaggtggcttaacgggtcttagtctcctggtttggcaagcgcttctcatcctcctgcgccctacgccccacccctcctttgtgtgatctgctttgcataaaacccagttatgcggggcagcgcacacaaaaacaccgccatttttgcaatcgccatcacgaatttcgccgatgcacggaacttgtgggggcagagccggtcgcctcatcctcccgtctcctcccccataaaaaagcgaagggtggaggatccacccgcgcaatcaatcccgcatagtccccgcatcttgaaggtttcagcgtagtaacaaagggagaagggcatggcgagcgtgcacttgcgcaaggtaacgaaagcctggggcgacgtagtcgtttcgaaagacatcaacctcgacattaatgaaggcgagtttgtggtgtttgtcgggccgtcgggctgcggtaaatcgacactgctgcgcatgattgccgggctggaaacgatcaccagcggggatttactgattggcgatacccgcatgaatgacatcccgcccgccgagcgcggcgtcggcatggtgttccagtcgtatgcgctctacccgcacctgtcggtggcggagaacatgtcctttggtctgaagctggcgggcgccaaaaaagagatgattaaccagcgggttacccaggtggcggaagtgctgcaactggggcatctgttggatcgtaagccgaaggcgctctccggcggtcagcgtcagcgtgtcgccattggccgtacgctggtggccgagccgcgcgtcttcctgctggatgaaccgctgtccaacctcgacgccgcgctgcgcgtgcagatgcgtatcgagatctcccgcctgcacaagcggctgggacgcacgatgatttacgtgacccacgatcaggtcgaagcgatgacgctggccgacaaaatcgtggtgctggacgccgggcgcgtggcgcaggtcggcaaaccgctggagctgtatcactacccggcagaccgctttgtggcgggctttatcggttcaccgaagatgaacttcctgccggtgaaagtgaccgcaacggcgatcgatcaggtgcaggtggagctgccgaaccgccagcaagtgtggctgccggtggagagcagcgacgtgcaggtcggcgccaatatgtcgctcggcattcgcccggaacacctgctgcccagcgatatcgccgatgtcacgctggaaggcacggtgcaggtcgtcgaacagctgggccacgaaacgcaaattcatattcagatccccgccatccgtcaaaacctggtctaccgccaggctgacgtggtgttggtagaagagggtgccacattcgctatcggcttgccgccggagcgttgccatctgttccgtgaagatggcaccgcttgtcgtcggttgcacaaagagccaggcgtttaagcattcccataacttacacaaaatcattcagggtgcatcgaggcggcaagagaatgaatccccgggagcgtacataagtacgtgactggggtgaatgaacgtagccaacaaagaggcaacctgaatgatgaagtgtaaaaagaaaagcaatgctctcaggagatagaacgatgattactctgcgcaaacttccactggctatcgccgttacagcaggcattctgtctgctcacgctggcgcggtcgacttcaaaggttatgcccgttctggtatcggctggaccggtagcggcggcccgcaacagtgcttccaggcaactggcgcacagtccaaataccgtctcggtaacgaatgtgatacgtacgctgaagttaaactaggccaggaagtgtggaaagagggcgataagagcttctacttcgactccaacattgcctataactcttcacagctgaacgactgggaaaacgacaataccccggcgatccgtgaatttaacgtcgtgggtaaaaacctgatcgactccctgccaggcgcgaacatctgggctggtaagcgtttctatcagcgtcatgatgtgcacatgatcgacttctactactgggatatttccggtccgggcgcaggtctggaaaacattgacgttggtatcggtaaactctccttcgcagcaacccgttctacggaatccggtggttcatccgcagcggctgaacgcgatccggtgaccggtgaaagaacctataacaatgacgtgccgaacgacgtgttcgacgtgcgtttagcaggtctggaaactaacaccgacggcgtactggagctgggcgttgactacggtcacaccaacctgccggacaactacacgctgcgtcagggcggctcgaaagatggctggatgttcaccgctgaacatacccagagcatgatgaaaggctttaacaagtttgtggtgcagtacgccaccgactcaatgacctccaacggcaaaggccgtccggaaggcggcagcatcaataacgatggcagcatgatccgcttgctggatcatggtgcgatcaccctggccgatcgctgggatctgatgtacgtcggtatgtatcaggatatcgaccgtgatgacaacaacggcacccgctggtggaccgtgggcgtgcgcccgatgttcaaatggacgccgatcatgagcaccctgctggaagtgggctacgacaacgtgaaatcacagcgtaccgacgacaccaacaaccagtacaaaatcaccctcgcgcaacaatggcaggctggcgacagcatctggtcccgcccggctatccgcgtattcgctacctatgcgaagtgggatgagaaatggggttacgctaacaccaacgcggataccgctgccggttataccagtggtttagcgtacaacgatacctccgcccgtaccttcagccgtggcgacaacgacgaagtgaccttcggcgcgcagatggaaatctggtggtaatcccccgttaacctgacgtaatgaccaaaagaggggcgtaagcccctcaaccctttgggtgacgcgcgctattgcctggcaaccgtggcacctgtgaattcagaggtgaaaacaatgaaaatgaaaaaaagtctcgtcgcattctgtctgagcgccagcctgctggcggcatgcccgctttccgcgctggcggacgtcaactttgttccgcaaaacaccagcagcgccccggctattccggcggcggagctgcaaaaactgacctggacgccggttaaccagtccaaagcccagaccaccacggtggcgaccggcggacaaaccattaacgtgccggggatcagcggcccggtgatcgcctggagcgtgccggccaatatcggtgaacttacgctgacgctgaccagcgaagtggataaacaaacgcaggtctttgcgccgaacgttttaatcctcgatcagaacatgacgccatccgccttcttcccgagcgactatttcacctatcaggagccgggcgtgatgagcgccgatcggctggaaggcgtgatccgcctgacgcctgcgctgggtcagcaaaaaatctacgtgctggcctttacccgcgatcaggatttgcaaaagaccaccaaactgatcaacccggcgaaagcctatgccaaaggcgcgggtaacgcgatcccggatattcccgatccgctggcgcgccacgtcaccgatggcaagctgacgctgaaagtgaaaaccaacagcggctccagcgtgctggtcggcccgctgtttggctcctccggcccggatccggtgacggtgggcaatactgcggctccggctaccgcctatagcgcaccggcagcacctgttgctgcgccggccccggcacctgttccggcagtgaagaaagagccggtgctgaacgaaaccgaaaactactttaaccagggtattcgtcaggccgtcgccaaaggtgagatcgacaaagccctgaaattgctcaacgaagcagaaagcctgggatcaaaaactgcccgttcaacctttatcagcagtgtaaaaggcaaggggtaattcaccccgcaatgctgattttgctgtttggtgcgccttaacgggcgcacctttttttgcgccccgcgcacgctgttgcgtatctgttacgcttttgcaaaggacatgaactttgcccgcccgtctgtgccggttctgcgatacaatacttttacgttttgtaccggagagtaaggcatgtcacaccctgcgctaacgcaactgcgtgcgctgcgctactttgacgcaatccccgcgctggatccgcaactgctcgactggctgttgctggaagattccatgaccaaacgttttgagcagcagggcaaacaggtgagcgtgacgctgatccgtgaagcctttgtcgcgccggatgagatccctgaggagctgccgctgctgcctgcggaatcacgttactggctgcgcgaaattttactctgcgctgatggcgaaccctggcttgccgggcgcacggtggtgcctgaatccaccctcagcgggccggagctggcgctgcaaaagctgggcaacacgccgctcggacgttatctctttacctcgtctacgcttacccgtgactttattgaaattgggcgtgaggatacgctgtggggacgccgctcccgtctgcgtctgggcgggaagccgttactgctgacggaactgtttttgccggcatcgccgttgtactaagaggaagataaaatggagtggagtctcactcaggataagctgctggcctttcaccgcttgatgcgcaccgataaacccatcggcgcgctgttactgttatggcccacgctgtgggcgttatgggtcgccacgccgggcgtaccgccgctgtggatcctggcggtatttgtcgcgggcgtctggctgatgcgcgcggcgggctgcgtggtgaacgattatgccgaccgtaaaatcgacgggcacgttaagcgcacggcgaaccgtcctatgcccagcggcgcggtaacggaaaaagaggcgcgcacgctgtttgtggtgctggtgctgctggcctttgtgctggtgctgaccctgaacctgatgaccattgcgctctcggtggcggcgctggcgctggcctgggtgtatccgttcatgaagcgctacacccatttaccgcaggtggtattaggtgcggcctttggctggtccatacccatggcgtttgcggcagtaagtgagtccttaccactgagctgctggctgatgtttgtcgccaacgtcttatgggcagtggcctatgacacgctctatgcgatggttgaccgcgatgacgatctgaaaatcggcgtcaaatcgacggccattctgttcgggcgtcacgacaaactgatcgtcggcctgttgcaggtaatagtgctggcgctgatgaccgccgtcggctggctgaacgggctgggctggccttactatgcgtcgatagcagtagctggtgcgctctttatctatcagcagtggctggtggtgaaccgcgaacgcgaggcctgctttaaagcctttatgaacaataactacgtgggtctggcgctgtttttagggctggcggtgagttatctgctgtaaataaaaaaggccgggaggcggtgacgccttacctggcctgtgattctgtgcgtgtttgtaggcccggcaagcaagcgccgccgggcattacgttataccgcgtccgtctgactggttgcgctctcaatcgttaagcgcacatcagaggtcaccagatcggcgagcagctgataaacctgcaaggttttcgccggatccgcatcccccgtatcgctgatatagccctcgtcacgcagcgtcagcaccagcgtactgaacaccgccttatcgaagaactccggcgcgttaataccgtgtagcaccgacagacgctgcgccagcgtgcggctctctttttccagcgtactgcggttgatggacgggttcgcgctcagcagccagaaggtaatggcatagcgttgcagcgtttcacgggcgccggccgccagcagttgcagcgtgcgggagcgtgacggattgatatgcagacgatcgtctttatcaatgatcagcccctggcgcagcagttcggtggtcagggtatccagtacctctcctaacgcctctttttcccagcgcaggaacagctcggctttcagcatcggatacagcgcttcaacatgacgcagcatctcctcgcgggagatatggcgatgctgggtaatgatggccgccatcagggaaggcagaaccagcatatgcgcgatgttgttacggtagtaggtcatcagcaccgcctgctcgcgcggcagaatgatgatgtcgccgatggtatctttctcgacttcaaacttgttcatttgcagcgcgtgatcgataagccctgacgcggtgctggccggcacggtggcgtcttctgaataaggcgcattgcgcagcagatccagataacaatccagctgctcggtcagctgttcgcgggtcagcgaacgctggcgtgacgccagcagcgccgtcgaacacaggttcatggcgttcgccgcaccggcgttgttaatacgcaccatcagctcggcggcgatggtattcaccgtcggcgtcagccacgccgggcgcaccgcttcaataggatcgatcgcttcgcgccactccggcacatgctgattaagatacgcattcagcgggatcggttcgccaaagttcacataaccctggcccagattacgcagcttgcttaagccacgcaccatctgcatcaggttctctttctctttggtcgcgccgcgcagctctttggcgtaagtacccacttccatcacgtgctcgtagccgatgtaaatcggcactaacgtaataggacgggtgccgccgcgtaacatcgcctgaagggtcatcgacagggtgccggtcttcggatcgagcagacgcccggtacgggaacgaccgccttccacaaagtactccaccgaataaccccggctgaacagctcgccgagatactcacggaacaccgtcgaatagagtttgttgcccttaaaggtacgacggataaagaacgcgccaaggcggcggaaaatcggcccggcgggccagaagtttaggttaataccggcggcgatatgcggcggcaccagcccctggtggtaaagcacgtaggagagcagcagataatccatgtggctgcggtggcagggcacatagacgatctcgtgaccgtcgtgggccaactgacgcacgcgctcggcgttgtggacgttgatcccctgatacagccggttccaggtaaagctcagaatgcggtcagagacgcggatcatttcataggagaagttcgccgcaatctcttccatcagggcgacggcattttgctgtgccttttcatgggagatctttttgctgcgcgcttcgtcttccaccgcgcgggcaatggcttttgaggccagcaatttattgaacagatcctgacgcgcaggcaggcgcgggccgaccgcggccagacgctggcgggcaaaatgcatccgcgcgacacgcgccagtttctgggcgataattttgtcagtgccatgttcggtggccatgcggcgcagcgaaaccggcggcgagaagcgcacaaagctgtcgcgtcccagccaggagatagcaaagaatttctgtacgccgttaagcatacgcagcggcgggttgacctcgcctttctcacgacccggcgagcggccaaacatcaccgacaccggcaccatttgcacgtccagatcggggtggttgcggtgcagatcgaggtaatcatggaacagcttgatcgactcttccttcggcgtgtaccaggtgaacacgcggggtccgctgtgaataaagatatagcgcggcagcagcgtgccgtcgatttcgagtggctccagcggatcgggcagatcgtttgccagacactgcgcgcgcagggtcagtaaatctgccttcgagttgtacggtaagacgtacataatagggcgtgaggtatcaagtcccagttcctgggcaggttctgccggaatgggcttgctttttaccaacgcgcctaatggtaaattaagtaatttgtagtaaattcgtggccagccggacatatacgatgtgaagcctctggttaataatcctgttgcgccgcaagaatatcagaaagcgcgcgtaaattctgttgtaccaaggtctgcttgcatagacattgacgctaattacataaaaaggttcttttgatggccaataataccactgggtttactcgcatcataaaagcagcagggtactcctggaaaggcgttcgcgccgcctggatcaacgaagcggcgtttcgtcaggaagcggtagcggtgatcctggcgattgccattgcctgctggctggatgtggacgctatcacgcgcgtgctgctgatcggctcggtagcgctggtaatgatagtggaaattctgaacagcgcgattgaagcggtggtggaccgtatcggcacggattttcatgaactttccgggcgcgcaaaggatatgggctcggcggcggtgctgatgtccatcctgctggcgctcgccacctggggcatgctgttgtggtcgcattatcgataatgctcgcataaatcgacaaactccgctgttttgctcaaaattcgattccaaatttcactttgcctgtatatactcacagcataactgtatatgcaaccagggggcggtatgaaagctttaacggccaggcagcaagaggtgtttgatctcattcgggatcacatcagccagacaggcatgccgccgacgcgtgcggagatcgcgcagcgcttggggttccgttccccgaacgcggctgaggaacacctgaaagcgctggcgcgcaaaggcgtgctggagatcgtttccggcgcgtcccgcggtattcgtttactgcttgaagatgttgacggactgccgctggtcgggcgtgtcgcggcaggtgaaccgctgctggcgcagcagcacattgaaggccattatcaggtcgatcccaatctctttaaaccgaatgcagacttcctgctgcgcgttagcggcatgtcgatgaaagatatcggcattatggacggcgatctgctggcggtgcacaaaacccaggaagcccgcaacggccaggtcgtggtcgcgcgtattgacgatgaagtgaccgttaagcgcctgaagcgtcagggtaataccgtgcaactgctgccggaaaacagcgagttttctcctatcgtggttgacctgcgcgagcagagtttcaccatcgaagggctggccgtcggcgtgatccgcaacggtgagtggctttaatctcttctttccacgcggcggcaacatcatgattgccgccgcgcgtccgtttcccttctggtaattcaacgtggcctttctgacgacttccgacaaagcgttgtggcgtcttgcgctgccgatgattttttccaatatcaccgtgccgctgttggggctggtggataccgcagtcattggtcatctcgacagcccggtgtatctgggcggcgtggcggttggcgccatggccaccagcttcctgtttatgctgctgctttttctgcgcatgagtaccaccggttttaccgcccaggcctttggcgcaaaagatccccatgcccttgcgcgggcgctggtgcaaccactgctgctggcgttgatcgccggtttcgccatcatcctctgtcagaccccgctgattaatctcacactgcacattgtgggcggcaacgacgcggtgctggagcaggcgcggcgttttctggagatccgctggctgagcgccccggcgtcgctggcgaacctggtgctgctcggctggctgctgggtatccagtatgcccgcgcgcctgtggtgctgctggtggtgggcaacgtgctgaatattgccctcgatttatggctggtgatggggctgcacatgaacgtgcagggcgctgcgctcgccaccgtcattgcggaatacgccacttttgtggtcggcctgctgatggtacaacgcgggttgcgtcgccgggggatcagcctggcgatgctgaagaccgcctggcgcggcaatataaggcggctgctggcgcttaaccgcgacatcatgctgcgctcgctgctgcttcagctgtgctttggttccattaccgtgatgggcgcgcgtctgggtggcgacatcgtggcggtgaacgccgtgctgatgacgctgctgacttttaccgcctacgccctggatggttttgcctatgcagttgaggcccattccgggcaggcctatggcgcgcgcgatggcagccagttgctcagcgtctggcaggcggcctgtcggcagtcggggatagtggcgctggcgtttgcgatggtgtacgcgctggccggtgagcagattatttcgctgctgacctccctgccggatctgcaacggcttgccgggcactaccttggctggcaggtgattttaccgatcgtgggggtatggtgttatctgctcgacggcatgtttatcggtgctacccgcgggacggaaatgcgtaacagtatggccatcgccgccgccggttttgccctgacgctgctcagcgtaccgctgctcggtaatcatggtttatggctgtcgttaaccgtcttcctggcgctgcgtgggattacgctggcgtggatctggcgtcagcactggcagcacggcacctggttctcataagttcactggcgctttattgcgttgatggttaaatattccgaataatctccgcttcgacatctccttaactacaataattatcacgttcagcagaaatcgaacgaactgatggatactgaatatatttttattcaaaccgaacgatgaggatatcattatgaataaagacgaagtcggcggtaactggaaacagttcaaaggtaaagcgaaagaacagtggggtaaattaaccgacgatgatatgactgtcatcgaaggtaaacgcgaccagctggttggtaaaattcaggagcgttacggctaccagaaagaccaggctgagaaagaagttggtgactgggaaacccgtcacgattaccgctggtaatcacggacttctgcggcaattagcgttacagctaccctgcccgaaaggtacaaggatgtaccaacctctctctacattcccaccttatttctaacgcggttttttcttcacctgaatgctgtgatcgtgctgacaggcaccctgatgacgacaggcttccacttctgaacatgccgcacataaaccatgcgcttcaatgacattatggcgtagcgcaaaacccattcgcgcggccagaccatgcataatatcttccacaccttccgccgcttcttctttgacggctccgcaacgatcgcagataaacattgccgacgtatgggccggattatcaaaaagatgacacagcacatagctgttggtggactcaactttatgcacaaagccctgctccagcaggaagtccagcgcacgatacaccgtgggcggcttcgcctgtggctcagatacccgtaataaatccagcagatcgtaagcgctgatcgccccttcctgcaggcttaatagccgtaatacttccaggcgctgtggagtcaggcgcacattgcgttgcacgcagagcttttcagcctgcgctaacatctcctgcgaagtggtcttatccatgggcatcctctggtggccgggtgcgaaaacatccactttatcatgttctgccttaaacgccgagatccgcacgcaggtgtgctatatctgaagcattatttatgaaggagaaaggacatgaaaaagcccgactgtattcggcactggcgggatctcgaaggtcccgacgaatcaggctacccggacagcgatgaacgtttttctgttggcgcgcctcttgcccgaaaactcgggcttacgcggctgggtatccatcacgaacgtctacctccgggccgacgcacatcgtatccgcacgcggaaagcgatgaggaggagtttatttatgtgctggaagggaatccggaggcgtggattaacggctatttatggaaactggaaccgggcgacagcgttggatttcctgccggaaccggcgtttgccatacctttatcaataacaccatggaagaagtacgcctgttggtcgtgggggaggcgaataaaagaaataaccgcatttattacccgctcaatcccgactatgccgccacgcgggacgatcgctggatagaccatcctccgcagtttttcggcccccatgatggaaaaccttcacgaaattaatttcgtcttctataaattaataggcccgtcaccggaacgggaaagcagtgaataagaccatcagcgttaaaacatcctttaaattgaattagccgtatttaacatcgttgttcacagcaatagttcatccccgttcgggcgataactgtcggggtaagatgttcaattattcaaagaagagcaaactgtgaaaaaaacattcaaatattcaatggttactctcgctgtctccttttttgtggcaaatcaggcgtcagcggccaatacctgggcagaagcgcgtggcgacgcaatgggtggtacgggtgttgcttccgcgagctatggcagcggcgcactcattaacccggccttgctggccaaagcaaagccggatgacagcgtgactgtgatcctgccagccgtgggcgcgcaaatcaccgacaaagacaatcttcaggatgagattgacgaaattaatgacaaagtcgaccgctacagcgacgttgtcgataaccttaccgcagcgcaaattattgctaacccgctgggcactatcgggcaattccagagcgccgctaaggatctggcggatgagctggaattccttgatggtaaaaccgcgcgcgcaagtgccggcgctggcattgccgttagtattcctaacgacgtgctgtcggtggccttcgtaactaaagcccatgcgcatgcccgcgtcagttcgaacattgatcagcaggatattacttacctgcgcagcatccagaacagcaggctggtggccgtcggtgaagcgcttaatgccgcgctgtcgccaaacggctctgatgaaatcaccgaaaatctgaactccaccgcctccgggcgcgcggctatcgtctcggattacggtatcgctgttgcccgtcagttccaggtgggtgaagttccggtttctatcggcgtaacgccgaaattccagaaaacctgggtctataactacaccacctccatttacgattacgacagcgacgatttcaaaagcagccgttatcgtaccgacgacaatggttttaacgtcgatgccggtattgcggcagatttcggcgaaaactggaccgtaggcgtgagcgggcagaacctgatctcccgcgacatcgacaccaaagatatcaacgtgcgtaacggccgtaccggtgaggtgagaaattacaaagacacctaccagatcagcccggtggtgacagcgggtgtggcatggcataacgatctggtgacggtaaccgccgatggcgatctgacggaaaccaaaggcttcaagagcgaagaaaactcgcagtatgtgggcgtcggcgctgaagtccgtccgttagactggatggcggtgcgtgccggttaccgtgcagacgtgaaagataacgatagcaacgtctttaccggcggtctgggcttcacggcctttgaacgcgcgcgtcttgacctgaccggtatcgtgggcgaaaacgaaacctggggcgcaggcgcacagctgagcctgaccttctgagttaaagcggaccgggggcgcatcgcctccggtctgctaatgtgtaccccggaaatgagtgtgttatagtagcgcccctttttcatattgatgcaaaaatgtacgctatggcacccgtaactccgtccacccaattcgcttcctcccgcttctccatcgcgccgatgctcgactggacggacaggcattgccgctactttttgcgtctgctgtcccgcgatatgctgctctacaccgaaatggtcaccaccggcgccattattcacggcaagggcgattatctggcgtacagcgaggaagagcatccggtcgccttacagctgggcggcagcgatccgcagcagctggcgcagtgcgccagactggcggaagaacggggctacgatgaaatcaacctcaacgttggctgtccgtccgaccgcgtacaaaatggcatgttcggcgcctgtctgatgggcaacgcccaactggtggctgactgcgtaaaagcgatgcgcgacgtagtgtcgatcccggtcacagtaaaaacccgtatcggcattgacgatcaggacagctatgaattcctgtgtgatttcatcagcaccgtctccggtaagggcgaatgcgacacctttattatccacgcccgtaaagcatggctgtcaggtttgagcccgaaagagaaccgcgagatcccgccgctggattacccgcgcgtataccagctgaagcgcgatttcccgcagctgacaatgtcgattaacggcggcatcaaatcactggcggaagcgaaagcgcatctggaacacatggatggcgtgatggtaggccgcgaggcgtaccagaatccggggatcctcaccgccgtggaccgcgagatctttggtcgtgaccgcgcggatgccgatccggttgccgtggtgcgcgccatgtatccgtacattgagcgtgaactgagcaaaggggcctatctggggcacattacccgtcatatgctcgggctgttccagggcattcccggcgcgcgtcagtggcgtcgccatctgagtgaaaatgcgcataaagcaggcgcagatattcgcgtagtggaacaggcgctggcgctggtggcggataagcgttaaaaacttcgccagaatttggtcagattcaccacgcctcgcgttaatccgcggggcgttttcgttttatttcagcaggttaactttggcacggatcttgtaatacctgagacaagaatgaaagaaacgtctttcgggagagagccatgctggaactactttttgtcattggattttttgtcatgctaatggtgaccggaatttccctgctcggcattattgccgcgctggtggccgccaccgcgttaatgtttgttggcgggctgttcgcgctgatgattaaactgctgccctggctgctgctggcggtggcgattgtgtgggtgatacgggcgataaaaacgccaaaaatcccacattatcagcgcaataaccgctggcgttactaaggttatgcgtggttgatcacaacctcgtacttttcagaggtgagttcgctgaaaccgcataggatttacttatcggatctggcactatggcgcggttaacgaattcatcgtgctgtcccctacaaacagccgaactaaaaaaagaatgggcctcctcagggaggccctaattcttttaagggatcagtaaacttgacccctgagtggcgcggctttccagtacctcatgcgcccgttgcgcatccgccagcgcaaacttctgatcttccgccacatccactttgatcacgccgctggcgatcagcgagaacagttcattgctggcttcttccagctcctcgcgattggtgatgtagccttgcagggaagggcgggtggcaaacagcgagcctttctggttgagaatccccagattgacgccggtcaccggcccggaagcattaccgaagctcaccatcagcccgtggcgttgcaggcagtccagcgaggcttcccaggtatctttccccaccgagtcatagaccacgcgcaccttcttgccgccggtgatctcttttacccgctcaacaatgctctcttcacgataattgatcacctgccaggcaccggcctgtaacgcgcgctgcgctttttgcgcgctacccacggtgccgatcagcttaccgcccagcgccttcgaccactggcaggcaatcagccccacgcccccggcggcggcatggaataaaaagggttcgtcgggtttaatttcgtaggttttacgcagcagataaaacaccgtcaggcctttcaggaaggaggcggcagcctgttcgaaggagatggcgttaggcaaaatcgctgctttatcggcaggcacgttatgcactgagctgtaagccccgagcgccgactgggcgtataccacccggtcaccggctttgatatgggttacgcctttacccactttgctgaccacgcccgcggcttccgttcccaggccgctcggcagggaaggcggtggataaagcccgctgcgaatataggtatcaatataattgataccaatggctttgttctcaacctggacttcattttccgccggatcggtgggggtgaactccaccgctttcagtacctcagggccaccatgcttgtgaaattcaattcttgttgccatgcttcctcctgaactctgtggtaatctttcgacccaatcatcatctcggtaactccattcactatggcaggaaataaacccttcaacaaacagcctgaacctcgcgacttcaaggtcgaagggatgaaagtccccccgcactcgattgaagcggaacagtcggtgttgggcggtttaatgctggataacgaacgctgggacgatgtggccgagcgcgtagtggcggaagatttctatacccgcccgcaccgccacatcttcactgagatgcaccgcctgcaggagatgagtaaacccatcgacctgatcacgctcgcggaatcgctggagcaacaggggcaactcgacagcgtgggcggctttgcgtatctggcagagctgtcaaaaaatacgccaagcgcggcgaacattagcgcatatgctgacatcgtgcgtgaacgcgcggtagtgcgtgaaatgatttcggtggcgaatgagattgccaccgccggtttcgatccgcagggccgcagcagcgaagatctgctcgatctggccgaatcccgcgttttccagatcgctgaaaatcgtgccaataaagacgaaggcccgaagagtatcgatcagatccttgagtccaccgtggcgcgtattgagcagcttttccagcagcctcatgacggcgtgacgggtgtggataccggctatcaggatctgaataaaaagaccgcgggcttacagcgttcggatttgattatcgtggcagcgcgtccgtcgatgggtaagaccacttttgcgatgaacctctgcgaaaacgcggccatgttgcaggataaaccggtcttaatcttcagtctcgagatgcccgccgaacagatcatgatgcgtatgctggcgtctctgtcccgcgtcgaccagacccgtattcgtaccggccagcttgatgatgaagactgggcgcgtatctccggcaccatgggcattctgctggaaaagcgcaacatgtatatcgacgactcctctggcctgacgccgacagaagtccgctcccgcgcgcgccgtattttccgcgagcacggcgggctgagtctgatcatgatcgactacctgcaattgatgcgcgttccttctctttctgataaccgtacgctggagatcgccgagatctcccgctcgctgaaagcgctggcgaaagaattacaggtgccggtggtggcgctctcgcagctcaaccgctcgctggaacagcgcgccgataaacgtccggtaaactccgacctgcgtgaatccggctccatcgagcaggatgccgacctgatcatgtttatctaccgtgacgaggtttatcacgaaaacagcgatctgaaaggcatcgcggaaatcatcctcggtaaacagcgtaacggcccgatcggtacggtacgtctgacctttaacggtcagtggtcgcgctttgataactatgcgggtccacaatacgacgacgaataagggatctggtcggttttaaaacgtcagatccggtactcattaatgaaggaataacaatgcaagcggcaactgtagtcattaaccgccgcgctctgcgtcacaacctgcaacgcctgcgcgaactggctcctgccagtcgcctggtggcagtcgtgaaagcgaacgcttacggacacggtcttcttgagaccgcgcgaacgctccccgatgccgacgcctttggcgtcgcccgtctcgaagaagccctgcgcctgcgcgcgggaggcatcacccaaccaattttactgctggaaggcttcttcgccgccgacgacctgccgaccattgccgcagaacatttgcataccgccgtccacaataacgagcagctgacggcgctggaaaacgccgaacttagcgagccggtcaccgtctggatgaagctcgacaccggcatgcaccgcctcggcgtgcgccctgaagacgccagcgccttttatcaacgcctctgcgcctgtaaaaacgtgcgtcagccggtaaatatcgtcagccattttgcccgcgccgatgaaccggaatgcggcgccaccgagcagcaactcgatattttcaataccttttgcgacggcaaacccggacagcgttccatcgcggcctccggcggcatcctgctgtggccgcaggcgcattttgactgggtacgtcctggcattatcctttacggcgtctctccgttggatcataaaccctggggtccggacttcggctttctgccggtcatgtccctgacctcaaacctgatcgccgtgcgtgaacacaaagcgggcgagccggtcggctatggcggcacctggatcagcgagcgcgacacccgcctgggcgtggtggcgatgggctacggcgatggctacccgcgggcagccccgtccggtacgccggtgctggtgaatggccgggaagtaccgatagttggccgggtggcgatggacatgatttgtgtcgatctcgggccggacgcgcaggaaaaagcgggcgatcgcgtgaccctgtggggcgatggtctgccggtcgagcgtatcgccgaattcacaaaagtgagcgcttacgaacttatcacgcgactgacctcgcgggtggcgatgaaatacctcgactgatcgtattttgcaggtcccctgcgtggggcctgctgataaccttccattcacatccctctcgatcttcccgcgcttccggtttattgtggttatccgcaccgtaaacctggagaaccaccccgtgtttcagaaagttgacgcctatgctggcgaccccatcctttcgctgatggaacgttttaaagaagatccccgtagcgacaaagttaatctcagcatcgggctgtattacaacgaagacggtgctattccccagctccaggcgattacggaagcgcgggcgcgcctgaatgcccggccgcacggtgcctcgctttatctgccgatggaaggcttaaacggctatcgccataccatcgcgccgctgctgttcggggcggatcacccggtattaaacgcgcagcgcgtcgccaccatccagacactgggcggctcaggggcgttgaaaatcggtgccgatttcctcaaacgctacttcccggactccggcgtttgggtcagcgatccgacatgggaaaaccacgtcgccatttttgaaggcgcaggttttaacgtcgatacctacccgtggtttgatgccgccactaacggcgtgcgcgcggaagcgttactcgaaaaactgaacacgctgccggcgcaaagcatcgtgctgctgcatccatgctgccacaacccgaccggcgcagacctgactaacgctcaatgggatgcagtcgttgaagtgctgaaagcgcgcaacctgatcccgttcctcgacatcgcctatcagggctttggcgcgggtatggaagaggatgcctacgccatccgcgccattgccagcgcagggctaccggcgctggtcagcaactccttctcgaagattttctcactgtacggcgagcgtgtcggcggtctgtcggtggtctgtgaagatgccgacgctgccgcccgcgtgctgggtcagctgaaagccaccgtacgtcgtaactactccagcccgccagcctttggcgcgcagctggtggcgacggtgctgggcgacgacgccctgaaagccagctggctggcggaagtggaagccatgcgcctgcgcatcctggcgatgcgtcaggcgctggttgatgtcctgaaggatgcggtgccggatcagaactttgattatctgctcaaacagcgcgggatgttcagctataccgggctgagcagcgcccaggtggatcgcctgcgcgatgagtttggcgtttaccttatcgccagcggacgcatgtgcgtcgccgggctgaatgctggcaacgtacagcgtgtggcacaggcctttgccgctgtaatgtaagtacttgcttactgctctctctcccggtgtcatgcggccgggcgggagagcagaatgcgatccgtcttctgtttcccgcctcttttttaagaatattcttcctttcacctgcccgtgacgttaaggtcgggtaaatttttgatcgtccgcgcaggttgcaatgattgcgggctgataatgcagggaaaaatatgcgcaaaatcacacttatcctcagcgcctttagtttgctgttcacgcttaatggccccgttaccgctcacgcctcgtcgccttcgccccttaatcccggtactaatgtcgcacaactggcgcaacaggcaccggtgcactgggtatccgtggcgcaaatcgaaaacagtctgctgggacgtccgccgatggccgtgggttttgatattgatgacaccgtgcttttttccagccccggcttctggcgcggcaagaaaacctggtcgccggacagcgaagactatctgaaaaatccggcgttctgggaaaagatgaacaacggctgggatgaattcagcattccgaaagaggtggcccgcgcgttgatcgccatgcatgtgaagcgcggggactctattttcttcatcaccggccgcagcgaaaccaaaacggaaaccgtcaccaaaaccctgcaggatgacttccttattccggccgccagcatgaatccggtgatttttgcgggagacaagccaggtcagaacaccaaaacacagtggttacggggtaagcaaatcaaagtgttctacggcgactccgataacgatattcgcgccgcgcaggaaactggcgcgcgcggtatccgcgtactgcgtgcctccaactccacttacaaaccgctgccgcaggcgggcatgttcggtgaagaagtgatcgtcaattccgaatactgatccccaacggcagtcgcaggattgccgtttttttaatctctgctggcggaaacctggctgaaaacgcactcatgctgcacacttagaaagatttattttcgacagggagctgcaccagaggtgccaacaacaggggaaccccaatgaccaatgcagaattactgccctattgcatgggcaaggcgggagcggaacagagcgtacacagcgactggaaagcgacgcagattaaagtggcggatgtgctgtttgcaatggtgcacgaaacggatggccgtccggcggtcacgctgaaaaccagcccggagctggcggaattattgcgtaatgaacacagcgatgtgcgccccagcgcgcgtctgaacaaagcgcactggagcacggtatttctcgatggatcgctgccggattcgcagatttactatctggtagacgcctcgtatcagctggtggtcagtgcgctgcccgacgccgtcaggcagcaactttccgtctgattacttcagcatcggtttgaggaagcgcgccgtgtgcgaggcttcgcacccggcaacggtttccggcgtgccggagacgaggatttccccgccgccgctgccgccttccggccccagatcgacgatccagtctgcggttttgatcacgtccaggttatgctcaatcaccacgatggtattaccctgatcgcgtaactggtgcagcacttccagcagttgctgaatgtccgcgaagtgcaggccggtcgtcggttcatcaaggatatacaacgtctgaccggtaccgcgtttcgacagctcacgcgccagcttcacgcgctgtgcttcaccgccggacagcgtggtggcggattgtccaagacgaatataggtcaggccaacgtccatcagcgtttgcagtttacgcgccagtgatggtacggcatcaaagaactcgcgcgcttcttcgatggtcatatccagcacttcatggatcgtcttgcctttgtatttgatctccagcgtttcacggttatagcgcttgcctttgcactggtcgcacggcacataaatgtccggcaggaagtgcatttcgactttgatcacgccatcgccctgacaggcttcgcaacgcccgccgcgcacgttaaagctgaaacggcccggcgtatagccgcgtgaacgcgactccggaacaccggcaaacagctcgcgcacgggcgtaaacacgccggtgtaggtcgccgggttagagcgcggcgtacggccaatcgggctctggtcgatatcgataactttatcgaaatgttccagaccctgaacgtcacgatagggcgcaggctcggcgatggttgcgccgttgagctggcgctgggcgatcgggaacagcgtatcgttgatcagcgtcgatttacccgagccggacacgccggtgatgcaggtaaacaggcctaccggcagcgtcagggtgacatccttcaggttgttgccgcgcgcgccggtcagcttaagcactttttccggatccgcaggcacacgcgctttcgggatctcaatcttacgtacgccgctcataaactgcccggtcagcgattccggcaccgccatgatgtcttcaagcgtaccttcagccactacctgaccgccatgaacgcctgcgcccgggccgatatcgataacgtgatctgcggcgcggatcgcatcttcatcatgctccaccacaatcaccgtgttgccgaggttacgcagatggatcagcgtgccgagcagacgttcgttatcgcgctgatgcagaccgatagacggctcatccagcacgtacatcacgcccaccacaccagcaccgatctggctcgccagacggatacgctgcgcttcgccgccggacagggtctctgccgaacgggacagcgtcaggtagttcagcccaacgttcacgaggaatttcagacgatcgccaatctctttcagcactttttcagcgatttttgcacgctggccggaaagtttcagattggtgaagaaatccatcgcatggccgatgctcatgtcggaaatggtcggcagcggcgtgtcttccacaaacacgtggcgcgcttcacgacgcagacgcgttccgtcacaggtggtgcacgagcggttgctgatgaacttcgccagctcttcacgtaccgcgctggattccgtctctttataacggcgctccatattgtgcagcacgccttcaaacggatggcgtcgcacggaagtatcgccgcgatcgttcatgtacttaaattcgacgttctctttgccggatccgaacagcaccactttatgtacgttagcgctcaggctggcccacggcgcttccacgtcgaacttgtagtgttcggcaagggagcgcagcatctggaaataatagaagtttcggcgatcccagccgcggatcgcgccgcccgccagcgacagctccggattctggatcacccgatccggatcgaaatactgttgtacgcccagcccgtcgcaggtcggacaggcgcccgccgggttgttgaacgagaacatacgcggttccagctcattcatgctgtagccgcaaatcgggcaggcgaagtttgcggagaacagcagttcgcccgctttggcgtcgtccatatcggccacgatcgccgttccgccggagagatccagcgcggtttcaaaggattccgcaaggcgctgcgtcagatcgtcgcgcactttaaagcggtcgatgaccacctcaatggtgtgtttcttttgcagctcaagcgtcggcggatcggaaagatcgcagacttcgccgtcgatacgggcgcggatataaccctggctggccaggttttccagcgttttggtgtgctcgcccttacgatctttgatgataggcgccagcagcatcagccgcttgccttcaggctgcgagagcacgttatcgaccatctgactgaccgtttgcgcggccagcggaacgttatgatccgggcagcgcgcttcgcccacgcgggcaaacagcagacgcagatagtcatgaatttcggtaatggtcccgaccgtggaacgtgggttgtgcgacgtcgacttctgctcaatggagattgccggcgacagcccttcaatatgatcgacatctggcttttccatgagggacaggaactgccgcgcataggcagagagcgattcgacgtaacgacgctgcccttcggcataaagggtgtcaaaagccagcgaggatttgcctgaacccgaaagcccggtcacgacaatcagcttgtcgcgtgggatgacgatgttgatgttcttgagattatgggtacgcgcgccccgtacttctatcttatccattcacctttcccggtagagattcggctgccatagcgttatgcatccatttcggtaagcatagaacacgcccggcggtctgaactgaaacgattaattatgacacaatttaacctgaatggatatacagtgttatgatgcgccttccagtgagtcttgcaacaatgtcgcgacggcgcggtttactggaatccgcctcgcaaggtatcaatcgcgcggtttgtaatgctacaatcgcgcgtttacactattaagaaacgtattcaggagacacgaccatggccagcagaggcgtaaacaaggtgattctcgtcggtaatctgggccaggacccggaagtacgctacatgccgagtggtggcgcagtcgccaacattacgctggcgacctccgaatcctggcgtgataaaaacaccggtgagactaaagagcagactgaatggcaccgcgttgtgctgtttggcaaactggcggaaatcgccggtgaatatctgcgtaaaggctcccaggtgtatatcgaaggttccctgcgtacccgtaagtggaccgatcagagcggtcaggaacgctacaccactgaaatcaacgttccgcagattggcggcgtaatgcagatgctgggtggacgtcagggtggcggcgcaccggcaggcggcggccagcagcagggcggctggggtcagcctcagcaaccgcagggcggcggcaatcagttcagcggcggcgcgcagtctcgcccgcagcaaccgtcttcagcaccggcgcagtctaacgaaccgccgatggattttgacgacgacatcccgttctgatcctgaccatcagtacgcaaaaagccccgcattgacggggcttttgttttggtgcgacgccatcaggtgatgaccaccggccattcaggtggcgtgtgactggaggcttcaatcattacgtctttaatattattccagatcgccgccacatcaatcagcgtaatgccgagcaaaccggtggcgaaccagcaggcggcgatcacgcccagcccgctgctgatcaccgcaagaccgatataatcagacttgcgaaagcgaatgtttaatgtgctggcaagaaacatcagcaccgcgctcaataactgccagcgtagcaataccacgccggtggtaatggtagccatcaacccttcctctgataaccaatgaaacgtgatttcattttcacaatttttgtgaactatatcacatttgctcttttattcgccagtgatctgcgtcaattttgctcagtttcatatccataaagggggcgtcagccgctttgttagcgcctttcaggccacggctatatgcctcttttagaaacagaagggtaacaacattatttttttattatgcgtattctttgcacaccattcacttttgcagtttaaaaaataaacatctgccggttatcatttttatcggcctgcaatttgcgttaatcagcgatcccctgttgagttatcttaaaccttgacgacgaactggatatttattttccttaatataaacagggggaacacttttagtttgccttacggacgaatattatcgtcataagcagatattaggtttcttatgaaaaaagtcagttgctaatgtcttatgattcatgcaacgtaatcacctgttaatcaaagcatcctgtcgttattacaggcacacattttgcagggatattaggcggaaatgaatcatagcgcacttcgcaaggtgctgaggatcgtcgggatcatcatggtagttatactgcctgtgatgctggcgctatggtttgcacacatccgcgcggtaaaagaaaccagcgcgcagctcaatgcatttgcgcaactcgcgctggataaaaccgagctggtgatccgtcaggcagatattgcctatgacgaagccctgaaattcagcggcccgctctgttcgccgttgcatcggcaaaatatgcttaatattattcgcgggcggctttatctggcggatctcatctatacccagggcgatcattttttatgctccaccagtattactttgcctcaaccttatattattcctgctgctgattataaacgtaatcctgacgtttcaatttattactatcgcgatacgccattttattccggatataagatggtgtatatgcggcgcggtaattatgcggtagtggtaaatccacttttttacagtgaagtggcatcagacgatcgtacattaacgtatggcgtttatgacaatatcagtaaaaccttcttttcagtcagtcctggcgctaacgttaaaatattgtctgaacatgtacaaaatgagaaattaaacttccggacagataatcgtttctataccattgcccattccgacaagcgacctgtttcgatgatcgtctcgacgtccagcacccgctattatggtttcctgtatcatcaggccatgctgttggtcccgctggcgctgatcggcagtattctccttctactgatagtctcacgtacccggcatgaatttaactccccgcggcgtttgctgcatcgggcgctgctaaagcgtcaactcaggctgcattatcaacccattatcgatatcaaaaccggtaaatgcgtgggcgcagaagccctgctgcgctggcctgggtttaatggtccggtgatgagcccggtggagtttataccgctggctgaaaaagaagggttgattgaacgcgtcaccgattatgtggttgaagaggtgtttaccgatctggggcatttcctcgccgccaacccgcacctctatatttcaattaacttatccgcctcggatttccattcgtcacgcctgattgcccttatttctgataaggcaacacattacgcggtgcgggctgaacaaattaagatcgaagtgaccgagcgcggctttattgatgtgccgaaaaccacgccggttattcaggcgttccgtcatgcgggttatgaagtggcaattgatgatttcggtaccggctattccaacctgcataatttatattccctcaatgtcgatattctgaaaatcgacaaatcttttatcgatactctgacgactaacagcaccagccatttgatcgctgaacatattattgagatggcgcacagcctgcgtctgaagatcattgcggaaggcgtggaaacggcggagcaggtcacctggctgctaaagcgcggcgtgcagttctgccagggctggcactttgcgaaggcattatcgccgcaggattttattcactgggcgcagcagcacgactaagcgcttgtcccggtagtctcaacagacgcctgacgggataagcgctcataggggtttacatctgatgacggtaatcgctgggcgttctgtcgaattcgcggcgaaatacacgcgaaaaggtttgctgcgatacatagcccaggtccatggcgatatcaaaaatgggccgccgcgtggtgcgcagcgcttctgccgccagcagtaaccggcgctgtcggatgtaatcccccaacgtctgatgcatcaccgcgcggaacattctctgtaaataccatttcgaataaccggactttctggcgaccacatcaatgttcataggttggtcgatatgttcatcaatccattcaatcagtgtctgaataatttgctgatgggacatactagcctctttgtcagttctgccgctgtcgttttgtctgcgggcgagtataattcctcaagttaacttgaggtaaagcgatttatggaaaagaaattaccgcgtattaaagcgctgctcacccccggcgaagtggcgaaacgtagcggcgtggcggtatcggcattgcacttttatgaagccaaaggtctgattaaaagtgtgcgtaacagcggtaatcagcggcgttatacccgtgatgtgctgcgttatgtggcgatcatcaaaatcgcgcagcgtatcggcattccccttgcaaccattggcgaggcgtttggtgtgttgccggaagggcacacgctcagccctaaagagtggaaagagctatcttcccagtggcgtgtggaactggatcggcgtatccatacgctggaagcattacgcgatgagctggacggctgtatcggctgcggctgtttgtcacgcagcgactgcccgctgcgtaatcccggcgaccggctgggcgagcagggcaccggcgcgcgactgctggaagatgattaatattcgccacaaaaaactaaagcgccgttacggcgctttagtttgtttcccggtcttttgtctttcgctctatcccacgggtttgtgggagggtctcccccgacatcaatacccctcggtgtaactaaaaacgctggagggtccggtttgtatcgacacttttagtgtaagtcagcagggcagctttgccagcggcaaccggggaattatcaccgaaatttttcgcgcatgatgcacaattttctatagtaagtacttacctggttaacggagtaaatcatgcttaaagtgcatcatcttaataagtcccgttcacagcgtgtgctgtgggcgctggaagagcttggcgtgccctatgagatcgtgcgttatcagcgcgaaaaaaccatgatggcccctgaagcgctgaaaaaagtgcacccgctgggaaaatcgccggtgctggaagatgacgggcgcattattgcagagtccggggccatcctcgaatacctccaggaaaactatgatccgcagggcaccctgaaacccaccgatgccgaccagcgcctgcagtaccgtttctggctgcattatgccgaaggctcgctgatgccgccgttactgatgaagctggtattcagcagcctgggcaagccgccggtgccgctgggttttcgcaccctcggtaaagcgctggggcagggggtgcaaaaaggctatctcaataaacagatcgaaacgcacgcccgctatatagaagcggagctcggcagccagccctggtttaccggggagtcccccagcatggcggatattcagatgagcttcccggtgtttgccctgctggctcgcggcggcgttgatcacctgcccaatttgcaggcatggaagaaacgcgtcgagatgcgtccggcctggctgcgtgctattgaaaagggcggtccgttcgagttgcctggggaataaaatcacgttagaaggcgataaaattgttacagggttgcgcatttacgacaacgtttgcgcatcccctgctgctttcttcgtcgtcctgagcgaaatttcataaaaagcgacaaagttaagttgaaatacccctgtggatggctggataatcgtttgcctttttcaacagccgttttgtttgcgcggagttaaacgtttgctttttgtggcactgctttgccgcaacgtagcacatggagatgacgtttaatctggcagtggattgtccgccacgcaaaccagcgaatataaaaattctcaggggatgttttctatgtctacgccttcagcgcgtaccggcggttcgcttgacgctttatttaaaatttctgcacgtggcagcactgtccgtcaggagatcgtagccggtcttaccaccttcctggccatggtttactccgtgatcgtggtgccaggcatgctgggcaaagcgggcttcccgccggcggcggtgtttgtcgccacctgtctggttgccggtctgggctctattgtgatgggactgtgggctaatctgccgctggcgattggctgcgccatctcgctgaccgcttttaccgctttcagcctggtgctcggccagcaaatcagcgtacctgtcgctctgggcgcggtcttcctgatgggcgtgctgttcaccgtgatttccgccaccggcatccgtagctggatcctgcgcaatctgccgcagggcgtggcgcatggcaccggcatcggtatcggcctgttcctgctgctcattgccgcgaacggcgtgggtctggtggtgaaaaaccccatcgacgggttgccggtagcgctgggccatttcgccagcttcccggtgatcatgtcgctgattggcctcgctgtgattatcggtctggaaaaactgaaagtgccgggcggcattctgctgaccattatcggcgtgtctgttgtcgggctgatttttgatccggcggtgcacttctccggcatttttgccatgccgtccctgagcgacgaacacggcaattcgctgatcggcagcctggacattatgggcgcgctgaacccgatcgtgctgccgagcgtactggcgctggtgatgaccgccgtgtttgatgcgacaggcaccattcgtgcggtggccggtcaggctaacctgctggataaaaacggtcagattatcgatggcggcaaagcgctgaccaccgactccctgagcagcgtcttctcaggcctggtgggcgcagcaccggcggcggtgtatatcgaatcggcggcgggtacggcagcaggcggtaaaaccggtctgacggcgatcaccgttggcgtgctgttcctgctgatcctgttcctctctccgctctcctatctggttccggcttacgccaccgcccctgcgctgatgtacgtgggcctgttgatgctgagcaacgtgtcgaaaatcgattttgccgatttcgtggatgcgatggcgggccttatcaccgccgtattcatcgtgctgacctgcaacatcgttaccggcatcatgatcggcttcgcctcgctggttattggccgtgtagtctcgggtgaatggcgtcgtctgaacatcggtaccgtggtgatcgcggtggcgctggtggccttctacgcgggcggctgggcgatttaattttccgatccggctcgaaaaaaagggtggcgcttgccgccctttttactttttaaggcacatcctgtttccattgcgttaagctgcatgttctattatgaaaggcatgatgcctcgtcatcgattataaagaatcatcgcaaacagggaacgcatggaaattttcttcaccatactcatcatgacccttgtggtctcactctcgggtgtcgtcacccgtgtcctgcccttccagatccccctgccgctgatgcagattgccatcggcgctatgctggccttacccacttttggtctgcatgtggagttcgatccggaactctttctggtgctgtttatcccgccgctgctgttcgcggatggctggaaaaccccaacgcgcgagtttctggagcacgggcgtgaaatatttggccttgcgctggcgctggtgctggtcaccgtggtcggcatcggctatctgatttactgggtggtgcccggtattccgctgatcccggcgttcgcgctggcagcggtgctgtcgccgaccgatgccgtggcgttgtccggcattgttggcgaagggcgcatcccgaaaaaaattatgggcatcctgcagggcgaggcgctgatgaacgacgcctcaggcctggtggccctgaagtttgccgtcgcggtggcgatgggcaccatggtcttcactgtcggcggcgcgaccgtggaattcctcaaggtggcgattggcggtctgctcgccggcttcgtggtcagctggctgtatggccgctcgctgcgttttctcagccgctggggcggggatgaaccagccacgcaaatcgtgctgctgttcctgctgccgttcgcctcttatctgatcgcagaacacatcggtgtgtccggcattctggcagcggtggcggccgggatgactatcacccgttccggcgtgatgcgctccgcgcctctggccatgcgtctgcgcgccaacagcacctggtcgatgctggaattcgtctttaacggcatggtgttcctgctgctgggtctgcaactgccgggcattctggaaacctcgctggtggcggcggaagccgatcctaacgtcgaaacctggatgctgtttaccgacatcattctgatttatgccgcgctgatgctggtgcgtttcggctggctgtggacgatgcagaaattcagccagcgcttcctcaccaaaagcccgatggaatttgggatgtggagcacgcgcgaactgctgatctccacttttgcgggcgtgcgcggggcgatcaccctcgccggtgtactctctattccgctgctgttaccgggcggggaacacttcccggcgcgttatgaactggtcttcctggctgccggggtgatcctcttctcgctgtttgtcgccgtggtggttttacctatgctgctgcaacatatggagatcgccgaccacgctcaacaggcgaaagaagagcggctggcgcgggcgaaaaccgctgacgtggccattgtcgccattcagaaaatggaagagcgcctggcggccaacgccgaggagaacattgacgatcagctgctgacagaagtcagttcgcgggtgatcggtaatctgcgtcgccgcgctgacgggcgtaataacgtcgaaagctccatgcaggaagaaaatctcgaacgccgcttccgccttgcggcgctgcgttccgagcgggcagagctgtatcatctgcgcgccacgcggcagatcagcaacgaaacgctgcaaaaactgctgcacgatctggacctgctggaagcgctgctgattgagaataagtaggatatgtccccctcaacctgtgggtgagggggctaaagcactactttgtcaggcgtgacaccagttcaaactctttaaaattcaccgggcgttgttgctgcatggagatattcccggcgataccggtaaggatcgacatcgcaccggcgcggtgatcggcggcacgctgcagcggatcgtgcgtggcggggccgaataaatccgccagcatggcgttatctccgccgccgtgtccgccttcaccgatggcgaattcagctttccagggcgcggcaaacatcgggaacaccgtgatgtcgcagccttccaggctcccttcgctggcgcgatcgccaccggcgttgacgtaagatttctccacaagcttcatctccagacggccttcactgccgttaaacaccacgttcagcccctcccatggcagataggcgttcagggaataggttagctgcacctgattctggtatttcaccagcaccgacatggtgtcttcaatggtgatgccgtcgctgaacacgctctgatcgcgaaaatagttatcttcgtgctcggcatccagatacagcgctttcagctggggattgtcctccatgtgcagggcaaagggatcctctttagcggcggcgtagccgtgggcgcggggataaaactgcgtgataccgcgtcgctcggcgttctctttaccataaaagcgcaggctgccttcggcatagacgcgctgcggatagctccccagccagaagttcatcaggtcgaaatggtgggtggatttgtgtaccagcaggccgccgctgttgcgcttttcccggtgccagcgacgaaaataatccgcgccgtgttcggtgttcagcagccattcaaagtgtaccgagttcacctcgccaatggtgccgttcatcagcagctcgcgcactttgctgtgatgcggcgcatagcggtagttaaaggtcacacgcacctgacggcccgtctcttcaatggcatcgaggatgcgcagcgcccgctgctcgtcgatggtcatcggtttttcggtgatcacatcacacccggcgtacagggcgcgcacaatataatcatcatgggtacgatcgacggtggtgacgataatcacgtccgggcgcgtctcgcggatcatctcctcaaactgcgaggcgtgccaggtggacgctggcgcagccccttcgtttttcagcaactgattggcgtagtgcatacgcgtgtggttggtatcgcagaaggcgaccagggtggccgtctctttccactgaccgccgatggccgcaatgtacatcccggcacgcccgcccgtgccgacaagggcatattttttcataccatcctcgattaattacttaatgaaattattggcttaacgcgtaagccagggcttccatcagcataaaaagcgggaagggcattgtcgtgacggcgcagagtgcaaaataaggtcaggaagatggagtggcgcaaactgtgacggggcttacaaaacgcgccgggaggctgtgacgcggatcgacttttgtcgcacgcaggacgtgatgttgctcacgatgaaacacaaccccggcccgcaggccgggggtaaaacagattaatgcgcgcggccctgatcgatgccgataccggtttgcgaacggataaactgggcgcggaacttctcgcgttccagtttcccttccgcggtattgtcggttgccgagaatacccagataccaataaaggccaccgcaatggagaacagcgccgggtactcatacgggaagatggcgctggcgtggccgaggatctgcacccagattgtcgggccaagcaccatcagcaccacggcggtaatcagccccagccagccgccgatcatcgcgccacgggtggtcagcttcgaccagtacatcgacagcagaatgatcgggaagttacagcttgccgcaatcgagaacgccagacccaccatgaaggcaatgttctgattctcaaacagaatacccagcaggatggcgatcacgcccagtaccagcacggtgatttttgacacccgcagctcgtcgcgctcggtggcccctttacggaacacgttggcgtacagatcgtgcgataccgccgatgcgcccgccagggttaagcccgccaccaccgcgaggatagtcgcgaaggccaccgccgagataaagccgaggaacaggttgccgcccaccgcgttggcaagatgcaccgccgccatgttattgccgccaatcagcgcgccggtggcatctttaaacgccggattcgcgcccaccagcatgatcgcgccgaagccgataataaaggtcaggatgtagaagtaacccataaagccggtggcgtagaacacgcttttccgcgcttcacgggcatcgctgacggtaaagaagcgcatcagaatatgcggcagccccgcggtaccaaacatcagccccagccccagcgacaacgcagagatcggatcttttaccagcccgcccggactcatgatcgccgtgcctttcgggtgcaccgccatggcttcggtaaacaggttattgaagctgaaaccgacgtgacgcatcaccataaaggccataaagctggcgccgaacagcagcagcacggctttgatgatctgcacccaggtggtggccagcatgccgccgaacagcacgtacatcaccatcagcacgcccaccagcaccacggcgatgtgatagttcaggccaaacagcagctggatcagtttgcccgcgcccaccatctgcgcgatcagatagagcgccaccaccaccagcgagccgcaggcggagagaatacggatcggaccctgtttcagacgatacgacgccacatcggcaaaggtgtagcgtccgagattacgcagacgctcggcgatcaaaaacagaatgatcggccagcccaccaggaaacccagcgagtaaatcaggccatcgtagccggaggtgaacaccagcgcggaaatccccagaaaggacgccgccgacatgtaatccccggcgatcgccaggccgttttgcagaccggtaatattaccgcccgccgtgtagtaatcgctgcgggtgcgggtacgttttgacgcccagtacgtgatgccaagcgtaaaggcgacgaacaccacgaacatgatgatcgcctgccagttggtcggctggcgctgcaccgcgccggtcagggcatctgccgcgttcgcggagaaagggagtatggcggcagccgccgtcagtaatctcttcatggtgcgtttacctcgcggatcacggcattgttcagacggtcaaactcaccgttcgcccgccagacgtaaacgccggttaacacgaacgaaaccaggatcacgccgacgccaacaggaatgccgcgcgtgacgctggtgccgggatagagcggcgtacccagccagccaggcgcgaaggcgataagcagaataaagcagacataaatcgccagcacgatcagcgacaaaatgatggcaaaccgttgccttttttcgaccagctccctgaaatgcgcgttatgttctatccgttgataaatgagttcattcatcacgaaatctccagaggctccctgtgtctttcgcgccgcaggtgcgttggccgcgctcgcccacacccagtcacatagttaactatgctcctggggatgtgctcgcttgccgccttcctgcaacgcgaaatccttcgggatggtttttatattttccctcccggtcaaaggaggggtaggggtaggatttattggcccgataagcagcgcgccaccgggcatttatggttatgacggcatcgtaatgccttgtttttcttccagcagtttttccactacgccaggatcggcaagcgttgaagtatctcccaggttactggtgtcaccggcggcgattttgcgcagaatgcggcgcatgattttgccggaacgggttttgggcagcgaatcggtccagtgcagaatatccggcgtcgccagcgggccgatctctttccgcacccagttgcgcacctcggtatacagttccggcgacggctcttcgccgtggttcagcgtgacataagcgtaaatcgcctggcctttaatattgtgcggaatacccaccaccgccgcttcggcgattttcgggtgcgagaccagcgccgactcgatttccgccgtccccagacggtggccggagacgttcagtacatcgtccacgcgcccggtgatccagtagtaaccgtcttcgtcacggcgcgcgccgtcgccgctgaaatacatattcttgaaggtggagaagtaggtttgttcgaagcgctcatgatcgccaaacagcgtgcgcgcctggcctggccatgaatcgacaatcgccaggttgccttcggtggcgccttccagcggattgccttcgttatccaccagcgccggttgtacgccgaagaacggcaggctggcggaaccggctttcagctcgatggcgcccggcaacggcgtgatcatgaagccgccggtttccgtctgccaccaggtgtccatcaccgggcacttttcgttgccgatttttttccagtaccactcccaggcttccgggttaatgggttcgcccaccgatcccagaatccgcagcgaggcgcggctggtgccgtcaatcgccttatcgccttccgccatcagggcgcggatcgctgttggcgcggtatagagaatattgacctgatgcttgtccaccacctgcgccatacgcgctggcgtcggccagttcggcacgccttcaaacatcagggtagtcgcgccgcaggccagcgggccatacagcagatagctgtggccagtcacccagcccacgtcggcggtacaccagtagatgtcgccgggatggtaatcgaagacgtatttgaaggtggtcgcggcatacaccagataaccgccagtggtgtgcagcacgcctttcggtttaccggtggagccggaggtataaaggataaacagcggatcttcggcgttcatcgcttccggctggtggtcgctgctggcggtcgccatcacatcgtgccaccacagatcgcggccttcctgccagtcgatagcgccgccggtgcgtttaaacaccacgacgttttcaatcgtcgtcaccgccgggttttttaacgcgtcgtcgacgttcttcttcagcggaatactgcgcccggcacgtacgccttcgtcggcagtgatcaccagccgtgagctggagtccacaatacgcccggcgaccgcttccggcgagaaaccgccaaaaataaccgaatgcaccgcgccaatacgcgcgcaggccagcatcgccaccgccgcttccggcaccatcggcatatagatagctaccacgtcgcctttcttaatgcccagcgtcagcaggacattggcaaagcggcacacttcgccgtgcagatcgcggtaagagatatgtttgctctggctggcgtcgtcgccttcccagatgattgccgtttgatcgccacgctcagccagatgcctgtccaggcagttagccgccaggttgagctgtccatcttcataccatttaattgaaacattccccggcgcaaaggaggtgtttttcaccttctgataaggcgtgatccagtcgagaattttgccttcctcaccccagaaagcgtcaggatcggtgatagattgctggtatttcgcctggtactgttcggcattaatcaggcatttttccgcgatctgggcgggaatagggtgtttgtggatttggctcatggcttttgttctccttgtaggatgttaataatatgtcacacaaacgttaattgtaggggctttgggagctttgtttactttttgggcgacagatcacgcaatgcttgagtgtatgaaaatgcagcagatgatgcttagaagggaaataatttacgctaagaactattgcttttatggcaattaaaaattcatctataacaaatagttatgcatgataaatgctataaaatgcgctttttaagtgagaaatcagcgaaagtccctgaacttaaagggttgcacgggataccacgcaaatggtactgataatgcgcgttaaaaacccccgcttttgtaagaaacgctaaccatcccccttgctggcagtcttcatgcacagcagggaatagcgcttcactaaggatgtcactcgttatgaaaaatgtgaaagtcagcctggcctggcaaattttgctggctctggtgctgggtattcttctgggtagttacctgcattaccaaagcgacagccgcgaatggctgattgcgaatctcctgtctccggcaggcgatatctttattcatctgatcaaaatgatcgttgtccctattgtgatttccaccctgattgtgggaattgctggcgtgggcgatgcgaaacagctgggccgcattggcgcgaaaaccattctttatttcgaagtgatcactacagtggccattattcttggcatcacactggcgaatgtattccagccgggcgcgggcattgatatgtcgcagctggcaacggtggatatttcgaaataccagagtacaacggcggaagtgcagagccatgcccatggcctgatgggcaccatactgtcgctggtgccaaccaatatcgtgtcgtcgatggcgaagggcgatatgctgccgatcatcttcttctcggtgctgtttggccttgggctgtcatcgctgccttccgcacaccgtgagccgctggtgacggtcttccgctccatttccgaaaccatgtttaaagtcacccatatggtgatgcgttatgcgccggtgggcgtgttcgcgctgatctcggtgacggtggcgaactttggtttcgcctccctgtggccgctcgccaagctggtgatcctggtgtatgccgcgattgtcttctttgcgctggtggtgctgggcgcggtggcgcgtctgtgcaagctgagcatctggacgctgatccgcatcctgaaagaggaattgatcctcgcctattccaccgccagctccgaaagcgtgctaccgcgtatcattgagaagatggaagcctatggcgcaccggcgtcgatcaccagcttcgtcgtgccgaccggctactcctttaaccttgatggctcgacgctgtatcagagcatcgcggcgattttcatcgcacagctgtacggcattgagctgtcgctggggcaggagatcattctggtgctgacgctgatggtcacctccaaaggtatcgctggcgtgccgggcgtctcctttgtggtgctgctggcgacgctgggcagcgtggggatcccgctggaaggtctggcctttatcgccggtgttgaccgtatcctcgacatggcgcgtacggcgctgaacgtggtggggaatgcgctggcggtgctggtgatcgccaagtgggaacacaaatttgaccgtaaaaaagcgctggcttacgagcgcgaggtgctgggcaaattcgataaaaccgcgaattcctgatttgcttaaaagatgcccggcggcgcgagcttgccgggcctacggcgtaacatgtaggcccggtaagcgaagcgccacagggcaatacccctctctcgttaacccatcgcgctttcgcgcagactggcttttaacttatcgtactcggcgatcacatactgttccgcggcacgctggtcggcaatccgctcaacgttaacggcgcagtacttgtactccggcgttttggttatcgggcttaagttctccgtcaccagctcgttacaggcgccaatccaccactggtaggtcatgtaaatcgcgcctttattcgggcgatcgctgacctgcgcgcgggtgatgatgcggcctttgcgggagttcacccagatcagcgcttcatcttcaatgcccagacgcgccgcgtcggcggtgttgatctgcgcatagccaggttcatccgccagcgccgccagcgccgcacagttgccggtcatcgaacgacaggagtagtggcccacttcccgcaccgtcgatagcaccagcgggtactcgtcggtcagtttgtcgatgggcggcacccaatcgcaggtgtagaacttcgccagcccggtatcggtttcaaacttctctttgaacaggtatgaggtcccctgatccgcgtccgacgtatcgcggcatggccactggatataacccagctcgcccattttttcataggtggcgccatagaagtccgggcacagatgacgcagctcatcccagatctcctgggtgttgttgtagtgcatcggatagcccatacgggtggcgatctcgctgatgatctgccagtccgttttcaggtcccactgcggctccacggctttgaagaagcgctggaagccacggtcagccgcggaatacaccccttcatgttccccccaggacgttgacggcagaatgacatctgccgccgctgcggttttggtcataaagatgtcctggacgatcaccagctccagatcttcaaagcctttacgcaccgccgacagctcggcgtcggtttgcagtggatcttcccccatgatgtaggccgcgcgcacttcgccatgagccgcccggtgcggcagctcgctgatgcgataaccagtgtgcgccggcagactggccacgccccaggctttggcaaatttctcgcggttttccggcacgtgcacatattgatagccaggatacgtgtccggcagcgcgcccatatcgcacgcgccctgcacgttattctgcccacgcaccgggttaacgcccgcgtgtggcttgccgaggttaccggtcagcatcgccaggctggtcagggagcgcacggtttccacgccctgatagaactgggtgacgcccatgccccacaggatcgccgcgcttttcgccccggcatacagtcgtgcgcaggtgcggatctcctcggcgctgacgccggtgatcgcttccaccgactccggcggatagcctgcaacaatctttttatactcgtcaaaatcctgcgtacgcgcggccacgaaagcatgatcgtagagatcttcgctgataatgacgtgcccgatggcgtttagcagcgcgatattcgagccgtttttcagtgcaatatgcatatccgcaatgcgcgcggtttcaattttgcgcggatcgcagacgataattttcgccccgttctttttcgcgcggatcacatgattggcgacgatagggtgggaatccgccgggttatagccaaaaataaagaccaaatccgtgttatcaatttctgtgatggcattgctcattgcgccattaccgaccgactggtgcagacctgcaaccgatgggccgtgtcagacacgtgcgcagcaatcaacgttattggtgccaataacggcgcgcgcgaatttttgcatcacatagttggtttcattgccggtgccgcgtgatgaacctgtggtctggatggcatccgggccgtacttctctttgatggcggaaagtcggctggcgacgtagtccagcgcttcactccaggataccgcttccagtttgccgccgcgctggcgacggatcatcggggttttcaggcgcggggtcaggatctgggtatcgttaataaaatcccagccgtaatagcctttaagacacagggtaccctgattggtcttcccctgcgccgcttccgcccggacgattttcccgttatcaaccacaaggttgattttgcaacccgaggcgcaataggggcataccgtgacgacttttttcatcggtctcactccagttttcaattcgcgcatacgcgcacttgcccccgttatgcagtttgcatgccatattctttatgtgggtatttctgcgggatgcggagcaggaaggaagtgaaaaccctgacgaaaagcgcgccgtcgtcagatttgacgtgtcgaacgtcggggaagagctgtaggccgggtaagcgcagcgccacccggcgcaatcgcccctcacttgcgccacatcaacatttcagtgtgatcaattcttataatcatcatacttttcctgcacaggttccctgtcgtgttcacactccgctcgatcatcactggcgtactgctctgtttttccgctgtcgccttctcacagactgacccgacgacgctcaccaccgcctggccggtcaacgttggcccgctcaacccgcatctttacacccccaaccagatgtttgcgcagagcatggtgtatgaaccgctggtgaaatacgcggcgggcggcagggtggagccgtggctggctaccggctggacgcactccgccgacgggaaaacctggatcttcaccctgcgcgaaaaggtcactttttccaatggcgaacctttcaacgccgacgccgccgcggcgaatttccgcgccgtgctggctaaccgcgcccgccatagctggctggaactggtgaaccaaatcaccgatgtcaaagcgctcggtccgcaaaagctgcaaattacgctgaaaagcgcctactacccgtttttacaggagctggcgctgccgcggccgttccgctttatcgccccgtcgcagtttgtcgatggcggcacgaaaaacggcattaaagcgccggtcggcaccgggccgtggatgttgcactcgtcgcgcctgaatcaggatgatgtcttcgtgcgcaacccgcattactggggaaaacaaccggcgatcggcagggtgagggttaatgtgatccccgatcccaccagccgcgccattgcctttgaaaccggggaggtggatctgctgtacggcagcgaagggctgctacccctcgataccttcgcgcgctttagccagaacccggcgtaccacacgcaactttccgcgccggtagaaacggtgatgctggcgctcaatacccggcttgcccccaccaatgagctggcggtgcgcgaagcccttaattatgcggtggataaaaaaaccatgatcgccgccgcgctctacgacacgcagcagctggcggacacgctgttcgccccgtcggtgccctatgcgaatatcgggcttaaaccgcgcggctacgatccggcgcaggcccgcgccctgctcgaaaaagctggctgggtgctgcctgccggtaacgctatccgcgagaaaaacggccagccgctgcgcattgaactggcctttaccggtaccgatgccgagagcaaggcgatggcggagattattcaggcagatttgcgcaaaatcggcgtcgatattcagcttatcggcgaagaagagagcagtatctacgcccgccagcgggacggtcgcttcggcatgattttcaaccgcacctggggcgcgccttacgatccccacgcctttatcagttccatgcgcgtgccatcccatgcggattaccaggcgcagctggggttgccggataaggcgctcatcgaccaggaaatcggccaggtgctgacgcagcaggatgaaaccgcccgccaggccttatataaagacatcctcacccggctgcatcaggaagcggtctatctgccgctcagctatgtctcggtgatggcggtatcgcggcctgaactgggagccatccccttcgcgccgatggcgtcagagatccccttcgaacagctcaatccggtggcgcagccatgatgctgaactgggcactacgtcgtttgctgctgctgatcccgatcctgctcgccgcgtcgctgctggtgtttttgatgctgcatctgggcgtcggcgatccggcgatggactatttacgcctttccggcgtgccgccgacggcggaggtgctggccgccacgcgggagatgctcgggcttaacgcgccgctgccggtgcagtactggcactggctgatgcgcgccgcgcggctggatttcggcgtctcttatgccacagggcgtccggtgctcgacgatctgctgcattttctgcccgccaccctgcaactggcgggactggcgctggtgctgatcctggcgatctccgtgccgctcggcgtctgggcggcgcgttatcccaaccgcctgccggatcatatcgtgcgcgtgatcgctttcctcggcgtctcaatgcccaatttctggctggcgtttctgctggtgatgctcttttccgtgaagctgaactggctgccggcgatgggttacggcggctggcgctacatgatcctgccggcggtttccattgcctttatgtccctttcgatcaacgcccgtctgctgcgcaccagtatgctggaagtggcagggcagcggcatgtgacatgggcgcggctgcggggcttaacggcggcgcaaaccgagcgccaccatgtgctgaaaaacgctgccgttccgctggtcaccgcgctgggaatgcacatcggcgagctgatcggcggcacgctgatcgtcgaaagtattttcgcctggccgggcgtcggccgttacgccgtctccgccatttttaaccgcgactatccggtgatccagtgctttaccctgctgatggtgaccgtctttgtgatcggcaatctgctggtggatatgatcagcgccgcgctggatccgcgcgtgcgcagccacgagggacagcacgcatgaacacggtttttcttgcccgctggccggtgcgcatggcgcttttgatcatcgctctgctgtttatggtggcgctgaccagccagtggtggctgccgttcgatccgctggctcttaatctgccggagcgcctgtcagcgccggacagccagcactggctgggcaccgatcacctgggacgcgatatcttcagccgtctgctggcggccacgcgtatctcccttggcgcagtgctgctctgtctgctgctggtgctgaccatcggtatgatcgcgggcggcgcggcagggttgctcggcgggcgcaccgatcagctggtcatgcgcgtcgccgatctgtttatgacctttcccacctcgatcctgtcgtttttcctcgtggcgatcctcggcaccggcatcaccaacgtgatcatcgccatcgccctgtcgcactgggcctggtacgcgcgcatggtgcgcagcatggtgctgtcgctgcgccagcgggagtttgtgctggccgcgcgtctcgccggggccagccgggtgcggatttttattgagcacatcagcggcgcggtgctgccgtcgctgctgatcctcgccacgctggataccggccacatgatgctgcatatcgcggggatgtcttttctcgggctgggcgtcaccgccccgacgccggagtgggggatcatgatcaacgacgcgcgacagtatatctggacgcagccgctgcaaatgttctggccggggctggcgctgtttatcagcgtgatgagttttaacctggtgggcgacgcgctgcgcgaccacctcgatcccggcagggctttgcaggagagccattcatgaacacgctgaccctcgacgggttttccttttatgctgccggtacgtgcctggtggataacgtctcgctgaccctgcgccgggggcgcgtactggcgctggtgggtaacagcggctgcggcaaatcgctgacctgcaacggcgcgctgggcgaactgccgccgggcgtgcggcgcaccggcgggcaggtgttgctcgacggcagagtggcggcggcccatgaactgcgcggcaggcgggtatcctgcgtgatgcaaaacccgcgcagcgcctttaatccgctgcgcaccatccgcgatcacgccagggaaacctgtcaggcgctgggtaaaaacggcagcgatgccctgctgctggcacggctggcggatgtcgggctggagcaggccgcgcgcgtactgtcactttatccctttgagatgagcggcggcatgttgcagcgggtgatgatcgcgctggcgctgctcggcgatgcgccctttatgtttgccgatgagccgaccaccgatctcgacgcggtggcgcaggcgcgtatcctcgatgtgctggcggatgtcatgaaaacccgcgcgccgggaatgctgctggtgacgcacgatatgggcgtggtggcgcggctggccgatgaggtggcggtgatggagcaggggcggattgtggagcagggcacggtggacgatctcttttatcgcccgcagcatccgctttcacggcggctggtgagcgcgcatctggcgctgtatggcgaggcgttgccgcaatgacgctgatcgccatccaccaggtttcccacggctacacctcgtcagggttgttccggcgcgggcagcaaaaagccgtgctggaagacatttcttttgacatccgcgcgggcgaaaccctggcgctgctcggacgcagcggctgcggtaaaagcacgctggcgcggctgatcgccgggctggaaaaaccgcagcgcggcgaggtgcgctatcaggggcagaatattcaccgcctggcgcgcgccgacgcacagcgctttcgccaggatgtgcagatggtgttccaggacgcgctgagcgcggtgaatccacgtaaaaccgtagcggaaattattgccgaaccgctgcgccacctgaccagcctgtcggcagcggaacagcaggagcgtattcttacgacgctcaccagcgtggaactggacgatgcgttcatgagcaaactgccgtcgcagctcagcggcgggcaactacagcgcgtatgcctggcgcgcgcgctggcggtacggccgaaattactggtgctggacgaggcggtgtccaacctcgatctggtactccaggcgcacatcgtggcgctgctgaagcagctccaggcgcagctgaatatcggctttctgtttattacccacgatctgcggctggtgaagcgcttctgtcagcgggtgatggtgatggacaacggccacattatcgaaacccgcccggtggatgcgcagctgtgctttgcaacgcctgccgggatcgccttacagcaggcggtattgcccgcttttccggtacgctaacagaagggaattgtatgcagcgcatcaccatcaccattgatgatgatttactggcaacgctcgatcgtctgagcgataaacgcggctaccagagccgttcagaagccctgcgggatattgtgcggcaatcgctggcggaagaagcggcgacagaggccgatcagcacggctatgcggtgctgagctatgtctatgaacatgaaacccgcgagctgtcatcgcggctggtggcggcccagcatcagcaccacgatctgtcggtgtcgacgctgcacgttcacgtcagccatgacgactgtctggaagtggcgatcctcaaaggcaatctgcacgatattcagcactacgccgacgaaatcatctcccagcgcggcgtgcatcacggccatttgcagtgcattcctgactgattaatacatctcaatatgcgtatcacgcggcagcgccagcagacgttcgccgtgggtgagcagcagatcaatgcccagcgggaaggcgtgcaggcggtcggcaagagcatgaacgatgcagtgcggcagttgcggcgcgatcatgcgctcctcatgaataccaggcccggtcaggcgcagcatacgaccaccgcttaagccggaaacctgcacgatcagcgtgacagggccaggctgcgcggcggcggcagcgaaaagggcgtccagttcggcggcgctgagcgtatcatcggccagcgcaagggtggcgaaatgtggctcattcaccagcgctgcgcgggtgtgcaggcgcagattctggatcacaaaatcgttatgcagcggattcgacagccacaccggcatgtttttatcggccagcgtcagcagtacgctggaggtcgccagattgagtggctgccagccgtgttttaactggtgcagggcaacaattacccccggctcgctcatggcttttaacagacgacgaaaactgtgctgcgcgtcctgcacgttattattcatggtggtcatggaatgcatggagggctccatagtgaagatgagagccagagtggcaaggaagtatgacgtttgcgttaagcagagatgacggaatagtgaagctggcaggggaaaggcaggggcgggaacgttatgtgcccacccggacgatcagttctttttcacaaattcggatttcagcttcatcgggccaaagccgtcgattttgcagtcgatattatgatcgccttccaccaggcggatgttcttcactttggtgccgattttcagcattgaagagctgcctttcactttcagatccttaacgaccgtcacgctgtcgccgtcggccagcagattgccattggcatctttgacgatcagcgtgtcgctgtcttccgacgcgctggcgtcgttccactcgttcgcgcattccgggcagatgtacatgccgttgtcttcgtaagtgtattcagaattgcatttcgggcagtgggggagttgcataatcattcctcaataaaaggctaatgggggtggaagtccgtccaccgaaaaatggcaggctgccaaaaaggtcgaagattgtacaccaaatccttactgttgtcggtgctattcttttttcactaaaagtgatcgacgtgacacaccctgtcaggcagttaagccatgcttaacaggtgaggtattctgatgcatgaatgagcgctaattttcaatatttttcggtggaaattgccactctgaaccaattcatatatggtgagatcacgcatccagtgttattaaaaagcagctctcggcaccagctctgtctcctgccgaagtcggcgacttacctctcaatttgggtgggtaaataaatgaagatatatcctggtaactcttaaaattagtctacgcgctgttgcttttgtttctgacatgagcaaagtaactcgctgaactgcatcataatttagaattttttattgagtcacgtcaggtagttatcttttttcagatatttttccacgcgtaattaaaaaagccgacactacattaaacaaaccgctcggctaaataaaagttataaaaatttgcgttaaggaaagacttttatcatgcacacacagacaatatttgaattgagccaggaagccgaaaggttgttgcagctttccctgcataatcttcattcattacaaacgatgccggtagcaaagcttgatgatgcgttgattaccgatataaacaacgcctccaatgttcatcctttgcatttcagcgcgcgtggaattgacgcccagcaggcgacgctgagtaacgaactacgcaaaattacccgtctggagatggtgctcgctatcgtcggtaccatgaaggcggggaaatccaccaccattaacgccatcgtcggcacggaagtgctgcctaaccgcaaccgtccgatgaccgcgctgccaaccctgatccgtcatacgccggggcaaaaagagccggtgctgcatttttcccacgtcggccctatcgataccctgacccaacagttgcagatgcgactgtttggcttcgatcgcgagaaactggcgcagaagctggaaattgataaggacatgcagacgctgctggatcgtattcgtcagggcgatgcttttgataagcactatctgggcgcgcagccgatctttcactgcctgaaaagcctcaacgatctggtgcgcctgtcgaaagcgctggacgtcgatttcccgttttcttcttatacggcgctggagcatattccggttattgaggtggagtttgtgcatctcgccgggctggaaaaaaacatggggcagttgacgctgcttgatacccccgggccgaatgaagccggccagccgcatttgcagcagatgctgaaagagcagctggcgcgcgcctcggcggtactggcggtgatggattacacccagttgaagtcgatttccgatgaagaagtccgcgaggcgattgccgccgtcggcaagtcggtgccgctgtttgcgctggtgaataagttcgaccagaaggatcgcaacagtgacgatgccgatcaggtgcgcacgctgatcgccggtactttaatgaaagggcatatcacgccgacgcagattttcccggtctcctccatgtggggttatctggcaaaccgtgcccggcacgagctgctgcgtagcggtaaactgcccgatcctgaagaacagcgctgggtgcaggactttgccgaagccgccctgggccgccgctggcggctgaccgatctggatgacagcgcgcatattcagcatgccgccgaattgctgtgggaagactcgctgtttgagcagccgatccagaaactgctgcacgccgcccatgccaatgcctcgctgtatgcgctgcgatccgcttcgcacaaactgctcaattatgcccagagcgcccgcgagtatctggattttcgctatcaggggctgacggtggcgctggaaaatctggagcagaatatcgcccggctggaagaggatacccgtctgctgcacgcctgccaggagcgggtcagcgacgaagtgaatcatgaagtggaagatgcgctggctgccgccgatcgctttatcaatggcgagcaggcgaccattatcagcgagatcgaccactattttacccacagcgagcgaccggaagaggccacgcttattaacgctgacgaggagtttggcgtcggtaaactggtgctggaggatgaaagccaggcgcaggtggcgctgagtaaaatccgctccgcctgcgaggtgattttgctgggcgcgcaggatcgcatcagccgggaactggcgcagcgtttcgatcagctggagtacaccctgacccggtcgttacaggatgcgatgcgcccgattgaaacccgtataaaggaagagctgagccacgccggttttcgcgcgcgcatcagcttaccggcgtttcaggccagcacgctgaacttcaatacgcggcaactgtttgtggatgccatcgccgccgaagatattcctgccgggcagtcgcgcgtcagcggcgtgcgggacagcatgtcgcgctggctgaacaatccgggctggggctggaatgattatgtcgtcacccgtacccgttacgttatcgacgtgacctcgctgcaccagaacctgattaatcacgtcgcgcatttttgcgcgcagatccgtaaggcgctggcggcgcaggttgatgtgtccgtaacggcggggatggcgacctttttcgccgagttttcgcacagtttgtcggggttacaggaaagcctgcgtgacagcctggcgattcgtcagcagaatgaatcgacggcggcggcgctgcgtcagcatctccggcaatgcatcaccactgccaactggatccacgaagatgcccggttgctgcgcgatgatattcaaaccctgtttgcggcagatcaaccatgaaaaaccgacttctcgacggacccgggcagacgctggagtgcatccagccaaaatttattgtcgatctggtgcagggcattgatgccccccggcagacgcaaatcgtgccccagcaacaggcgtttcgcgaacggctgacgcaggagataatgacccagacgcagctgcgtccgtgggcgatgtccggcatgtatcatgaaaacgatgcgctgcgtctcgggctggtggaaaaactcgccagcatgttcgatccgggtcagctggcgctggcgcgtatcacgcagcgcctgacgatgttgcagcagaacagtgaacgtcgccccgggctgtctgccgcgctgcaaaaacagtatgacgatatgctggcgcatttcagtctgcgcgccgcctcgaaagagaaagccctgacccagcgcgggctgatggtgcaggccggactgcacagcgagcagatttttacccgctggcgcgccgggaaatacgatggctggtcgctggccggacgctgttttatcgcgctggaagagctgcgctggggcgcgtttggcgatgcctgccgcttaacccggccggaagtgtccagcctgttgaaagacaatctgcgcattatggccgccgattttatggcgcaggggataggggcgtcaccggccacccgccatttctatcatcaatggttaaccacacccgccacgccgggcctgatggataataaagatctgctgggctggttgggggactggtgcgatgtcgatcgtcatccggtgtgctggtcagtgacgcaaagctggcaaacggtggcgctgggtatgccgcggctctgttctgcgacgcgtctggcgacggcgctggtggaggaagtctttagcgagggcgtgtaattcccctcccgccaggcgagaggggaaatagtctgtcagtgatgcagcgactctgtcgctttctcttgttcaaccgccgcaggcgattgttgcgggttgccatagcgcttcgcatagagcgcggtaatgatgggcaccagaatcgccgtcacaatcacactggctgccaccagcgccgtagctgatgcggctaccggttcgaaggccgggttaatctgcgcgataatcaccgggtttgccaccgccgcgcctgccgccgatgacgctgccacgcccgccgtaccgttaccaccgccaatccagcggtccgccaggatcagcgggataccggtaatgatgatgaccgccacgcccaggaagatccccagcagaccggtattcaagatcacattcaggttgatggtattccccagcgcgaaaccgaagaacgggatcagcaccggcgtcgctttgctgaagaatgcgcggaaatcgtgatcaaggttgcccagcgcaaaaccaatcaggaacggcaggaccgcgccgataaagtgatgcggttcgaaggaggccagaccggcggatccgaggatcaccatggtcatcagcgggccggattccagcgacatcagaacgaaggcgccagactcttctttggtgccgtactggttcatcaggctggcgtacaggccgccgttggtcatatccatggcagagacaatagccagcaccgacagcccggcaaagaagcccgcctgaattccggtttccggaataaaggtggcggcaatcattgccactatccatgccacggcaattttagtgatcaccagcgtaccggatttacgcagtaccgtgccggtagcgcgtaaatcaatggaggcgccaatacaaaagaaccacactgccagaataggcaccgtaccggtgatcattcctttcgtgaaggaaccaaaataagcgccggtatccggtgccagggtatttagaattgccccaagaagcaggggaaccagcatcatcccgccggggatgcgttcgatcgtggccttgattttcattgaagatcctcacgcttcaccgcgccatgcgcgcgataaaagctaaaaaatgtaaaattaataaaatcaatcagatagttcgctgatgagttgcgtttatctcatcgcggggatcgcgttatatgccgacaggtgccgccagtgctttcctctttaagtgtgcctggcgctatgatgcagtcatcggaatattgattcaatgaaaacgaaacagtgttttagttatctggatcacatatttcacgtaaagtttcttaaaggctccagatattaaaaagcctgtaaatgagttgtaaaaataaggtgtttttgaccgggttagcgattcgtttgaggatcaccttattcccataaaaatgagggttttgtcagcggtgggtaaatatgtgtgaagttgatcacggttttaaaccctgttagggtaaagaggtcattaactgcccgaacaggcgtcaacaggtttggctgtccagactttaaccagcttacgtaaccaaacctgctacgcttgatattaaagaacgcaatcacccggcaaccattaactgtgtagtgtaatgacgagagtttttacgcttccgtcggctgtgcgttcagggcaaagtccatgaggataaagaatgttaaaaaggaaaaaagtaaagccaatcacgctgcgcgatgtgaccattattgatgatgggaaacttcgcaaagcaatcaccgccgcatcgctcggtaatgcgatggagtggtttgatttcggtgtttatggatttgttgcttatgcgctcggtaaggtcttcttcccggatgctaaccccagcgtgcagatgatcgctgcgctggcgaccttctctgtacctttccttattcgtccgttgggcggattgttcttcggcatgttaggcgataagtatggccgtcagaaaatactcgccatgacgattgtcatcatgtccgtcagtaccttctgtattggtctgatcccctcttatgcctctataggcatctgggcgccgatcctgctgttgctgtgtaaaatggcgcaggggttctcggttggcggcgaatacaccggggcgtcaatcttcgtggcggagtactctcctgaccgtaagcgcggctttatgggcagctggctggatttcggctccattgccggtttcgtgctgggcgcgggcgtggtggtgctgatttccaccgtcgtcggtgaagagaacttccttgactggggctggcgtctgccgttcttcctggcgctgccgctgggtctgattggtctttatctgcgtcatgcgctggaagagaccccggcgttccagcagcatgtggataagctggagcagggcgatcgcgaagggttgcaggacgggccgaaagtctcgttcaaagagattgccaccaaacactggcgcagcctgctgacctgtattggtctggtgatctccaccaacgtgacctattacatgttgctgacctacatgccaagctacctgtcccataacctgcactattccgaagatcatggcgtactgattatcatcgccatcatgatcgggatgctgtttgtgcagccggtgatgggcctgctgagcgaccgttttggccgccgcccgtttatcattctgggcagcgtggcgctgttctcgctggctattccggcgttcattatgatcaacagtaatatcatcggcctgatttttgccgggctgctgatgctggcggtgatcctgaactgcttcaccggcgtgatggcctcctccttaccggcgatgttcccgacgcatatccgtttcagcgcgctggcgagcgcctttaatatctcggtgctgattgccggtctgacgccaaccctggccgcctggctggtggaaagctcagagaacctgatgatgcctgcctattacctgatggtggtggcggtgattggtttgattaccggtattaccatgaaagagacggcgaaccgcccgctgcgcggcgcaaccccggcggcgtcggacattcaggaagcccgtgagatcctgcgtgagcatcacgacaatatcgagcagaaaatcgaagatattgatcaggagatcgctgaactgcaggagaagcgtacccgtctggtgcagcagcacccgcgtattgacgagtaatcttcccctcaccccggccctctccccatgggagagggttaacatcccgccgcaataaaatccccgttcgcgctcaccggtattaccgttaaaaacagcactgaggcaaagaggattatcgccatccccccggcgattttcagcgccggaacaatccatgtctggcgctgcccgccaaacagcgccgccgtacggttgcgggcatagcgtaccgccagcgacaggccgatgatcgaaagaccggtgccgagcgacatggtcatcaccgctgccatgccccagctgaccatgcccagcgcattcgaaaacagcaaaatcatgatcgccccgctgcacgggcgcgcgccgatagagagcatcacgcccgcgcgcgttttccagtcgccgctggtggctaagcccacgccatgatgatgaccacagccgcagtccggcgcgtgtcctgtgtgaagcggtttcatgcgatggatacgcagtccgcgcgtggggaggcttctggcggcctgatagatcacatagcagccgaagccgccgatcagcagcgcgctgcttttttcgacgtaccagcggctttggctcagatcccccgacgccaggttaaagccaacggcgaggataaagacaaaggcaatggcgctgacgccctgcaacaggctaccgaaaaacgggatcagccgcgccgccagcgggctttcctgattagtgccgagccaggtggtaacgataaatttgccgtgccccggcccgatggcgtgcagcacgccgtaaaagaacgcgccgaccagcagccacaggccgccgctcagctgatgattattgagttgcagcagatacatcaccagataacggtgcagcgtgatctgcgtgctcaggcaccactgcaaaaaagcgccccagtggtggtgcaacagcagaagagccgccagcgcgataagggtgcaggttatcgcgccggggagccgccatgagcgggtcagtgctggagtcatcataaatgcccgtcgggaaatgatgaccagagtatagaggttaggccgcgttaaggtaacgggataactgccgctgatggtaacgcgccagcagcagcaccgtggtcagcgcacccagcagcgcgcagaacatgtctgactgggtatcccagggatcgccctgggtgccgaggaaatcgtccgcgccctggcccatcgccagtgccgcccaccactcgatcagctcatacatggcgctgatcgccagcgcaatacagcacaccacaaagccgagcattttccgcccgcgcacaaaggcaccgcgcaccaggatctcccgcgctgccagcgccggcaccagcccctggaaaaagtggccgagtttgtcataggggttgcggtcaagcccgagccacgcctgcacatcaaagccaatcggcactttcgcgtaggtatacataccgccgaccatcagaataatggcgtggaaaaaaatcagcgtatacagcaagggggtgaggggatagcgcgcgtgggtggcccacagcaggggaatgaggatcagcaccggcgtgacttccatcagccaggtaattttatcgccagcgtaaataccggtgtagacaacaatcagcgccagcagcagggctgcgacttttaacagagaggatggcatgggttttcatccggatgaaaaccttaactattgaccggaacggccgcggagacaacctgaaaataacaggggccgttaccggccccgtggaattaaatcagaacgatttgtttaaacgcaggctgaaggtgtgcgcctggtaagtatcgctggcctgaacatcgtaacgggcgtcgatggtcagatcattggcgctgtacagcgtggtgcccactgccagtcccgccatatctttcaccggcgacgcgcctttggtggtgaactgggtttcgcccagggtatcggccacgtaggacgcattattgctcatgcgacggttatcgtactggtggatccaggagatctgcgcaaacggcgtcagcgcgcccagcggggtatccacggttttctgcacgcggacgccgatatcgctgattacggactgggagtgcgaggcatcaacgtccagcgccatgccgttgccaccgctttccttatagccatcaacatgctgatagctgtaagccagtgcagccagcggcgtgaccacgacctgcgcaggcaacgtcagcggataaccgaattcgctttgcagcgtgacggattgaccgttgaatttgcccttcgccgtgccggagaagccggtgaaatcagcacgacgcaccgagtcatagttctgacggttcactgccgcagacagattcaggaaccacggattgccggtgtaagccgcataaccaatcacgccgtagttgtcagcggttgaggtgttgccgctcaggttgtttttgccgtgcaccgaggtgttgctgtagttcatcgctgcacccacgcgccagtcgtcgcccagcgcgcgatcggcaccgaggatcaggccgccgaatttcgcgctgtagccgctgacgtcgtcggtggtgtcctgacgggcataaccgccgaacggctggccccagacgatccagttgctgtagtcatcaccggtggataccccgctggcgcccgccgtctgcggattacgcacggtatccatatgattgcccaccaccgacatcgccgtggagttcgccacgccggttgccgtgctggcgctgatgctctgcccggtggacagacgttcgccgacgcggttcgcttcctgctcgccgtcaatggccagcgaggcgttgtaaagctcaagcagctgcggagagataccggagtaattcgccagaccacccagcgacgccgtggcgttaggcgtggttgcccgtactggctcagcaggctgcggttcagcaggagcagtcaccggcggagtcaccaccacaggcggcaataccggggtagtgacgaccggggtggtcacttccggcacggtaacgaccggcggtttttcggcgggtgtcgtgacaacaggcgttgtttccaccggggtgatgaccacaggcggcgtgaccaccaccggcgtctcgacaggcacgcttacttcaggcggtgtaaccacgaccggtggtttttccagggttaccaccagcgcactgttcgtattatcggtgacggtggaacctgtcacgaggccgtcatagcctgcggctttatagttcagtgtcccggcgttgtagtttgtgttagcgctgttcgcgtcgatcaccacataacgctgacccgccgcaaactgataggtgttgccggtacgcgcgagggagacgctggagccagcatcaacggtagccgcgccgctgacaaccagacggccatagctggtgtcggcagctttatcgccggtcgcgatcgcattatcagccacgccaaggatcagcgcgccagtggcattctgatggtaattaccagtgatattcagcggggtgttcacctgcagactggctgcgtcgttcaccacagtgcctggcgtgttgatgttatcattcagcagcagcgagccggagcggaagaagacatcgctggcgctctggatcttaccgatgccgttggtgccggtcagtacgcccacgttattattactaccgccgataatttccagcgacgcgccgttatcggagcgtaacgtgcctttgatcgtgccgctgttggccagcaccatggcggagccattattaccggaggcatgaattgcataggttgtgccggtaatagtgccgttgtttaccagattcagggtgctggtgttattcagataattgtaactgtagatcccgtaggcaccgctgatcagaccgttgttaatgatcacgctgcctgcgttattgttaatagcggcattattccggttatataacccgacaagggagccgctaattttactgttattagtcagcgtgttaataaggccgtcattgcggatccctatataggcactcttaattgtaccctcgttattaaaggtaccgatctcacccgtattgtagaccgcagcattattaccagcgttattattacctgtataggtaatggtgccggtgttattcagggtgccgatagtgccttcattccagataccgttagactgcgtatacatattcgcattatcagcgctgatgctaccgtcgttattcagcgtattaacggatataccctgcatgacatgaagcgcggagccgctggggggagcggtggcagaaccctgatcggtaataatgacccgatcgtaagcgttggcgatctgcacatcggactgtggggtattaatggtgtaatcactcgatatagcgagtgcgtgtggtgccagcagtccttgcgcggaggttaaagcaaccagcaaagatccttgctggcagatacgtaatttattcatgatgtaccattgcgatgtcgcgctgtttgtaaaaagtatgtgcgggtagtaacactgttcagactaatctgaatttgtctccggcgcagaacacccacttaatggctaacaaaacaataagcggtgcttaatgatttatcggcggaattaaggcgtactttaatatttaacttaaacctctctcgcgtggagccaggaaatggtaataaatcgtgggtattttaaagctgtgttattgattagcttcgttttattgttaagcggctgtactacctcggatccccgcgagactgctagcacacttgcgaaaaaacgccagctgacggcgcgagaattcgtcacggactggattactgtgcgcggctggcagcgcatcacgccgccggttacgcgtctgcgggtatatatcgaaggggatggttttgcctgggtcagccgcacgcgcccgtctgacgattcgacgccgcgtaacccggtgggcctgcaactggcggcggcggatccgtcggcgaacgtgctgtatctggcgcgcccttgtcagtttatcggcccgccgctgcccgccgcctgtcagccgcgggtatggacggatcagcgtttttccgccgcggtcgtggcggcgatgaacgcggcgttaagccaggtgaaggcgcaatatccgcaggcggagtttgagctggtgggctattccggcggcggcaatatcgccgcgctgctggcggcccgcaggcaggacgtcatcgcgctgcgcacggtggcgggcaatctggatgtggcttatgtgaatgcactgcatcatgtcaccgcgatgccggatgcgcagagcgccattgatgttgccccggtcctgaaaaacctgccgcagatccactacagcggcgcaaatgacagtaccgtaccgcccgccgtggccggacgtttccgtcaggcgaccggcccgcgctgtacgcaggtggcggtgatccccggaatggatcacggtggaaactgggcggcgctgtggccggaactgctggggagaaaggtggggtgcgggtgagcggcttaatctgcttcgacgagggtggagaatctgagcagaacatcgttaacaacggcttcgtccaggacttcaacaaaccgggcgtcgcgggcgttgagatcaatcatccgggcctgattgagaagaaccaccccctgcgttttactgccagagccggaaagcgaaacggtaaacccggcatgacgggcataattaccgccctgagtaaccggtgcgacgaacgccatgcccaaatcgttaaacagttttttcgtaagaatcaatgccggacgtggttcccgctgttcgctgccaacagcaggattaaaatcaaccatgactatatcgccgcgctgccatccctgcttacgctttaccatatttcattccccactggcgcatccttaccccatatttcttcttcgctggttgctggtgcgctggcatcgcactgtgcgaccagttcttcaagcgtatagcgttgacgtactggcgtcagaataagcgcgccgtcccggacttctgcatccagagactgaccagcgctgacacccagttgcctgagaagcagggcgggaaggataacgccattactgtttccccattttttgattgcaatgctcatcgcgaactccccatttgtttatacaaagtataactttcgggcatgaggtgttcaacatactcgcagataaactgtcaccagtaacgccagcagagtgcgcagaaggcattgttaacatcgccgaaagggtacgacagtttttggaccgtctttgcgaggcgcgccgcaaatcgcgctactgtttccgcttgccgttaatcgcgtctggcagtagcatcttcccgcacctgcaaaatcaggtgccgggattggtctcctgatgttaactcgttggcgacattgatttttatgtcgtgcgttctgctacatctcaatggtgggctgaacgggggcgccgcaaggtgcgccggtagccaacgagaccggtaagaccaactccgttcagtcccaccacccataagattggtctcttacgtggtgggttataaaacctcgttggagtctacccttatggctacctatatagagcagtccaataacttacttaccgttcccttcaccgcagatacagatttcaccgtgctggcggatcactgcgagcacttcgccgaagcgctgattgaaagcgatgatacggcgctgcgcctcgccatgtgcgggcgactcaatgcctgtctgacgctgctgcaacccacgctcaatgatgccatcccgccgcatcttattccggcgctcacggttgataccccgcctgcggaaccgccgcgtttcgaaccggaatccgacctgctttgtgaatactgcctgaccttaacgcgcgtactgaacagccagtcgctgccgccggatatggagaaaactcttacaggattgctgtgtgaactggtgtggtatttcgccgacatgatgaaagcgccgcgctgggtaaaaggtgtgtaagcgtagcctgctgtaaaagcttgccgggatcatgtaggcccggcaagcctgcgccgccgggcaagcagagttgaacagataaaccctgtcacaacattggtattttgcatacgatattattactgacctgaaagcatgccggaggacaacatcatgtcagcgaaacgcattatgtcagttaaatacgaaccactgactttgcgcattaagcccgccgaaggagagatgatcggtcgtgccgctggagaagcgctgatcgatcagcgcattatcatgatcgatcctgattcctgtcagaaatttatcatgcggatgggtcagatcccttcccagaatgtgtcgcttcgaaaaaccatgcaaactgccgccccgtgggagcaaaaaaaatgatcactaccctgagccagtgcaagccagcagattgatcccatgatgttaatggtgacgttaggggatttgattgagagcttaacgctacgcaataaatagaagcgattaaatgggatgccagaaagcaaaaaacccgccataagcgggtttttctgaatagtggtgcccggactcggaatcgaaccaaggacacggggattttcaatcccctgctctaccgactgagctatccgggcaacggggcgcattaaaccttaatcgctttacggcgtcaaccttatttccggaaatcgcatttatttgcttaactttacggcagtttgctgcaatctcagccatttttcgcctggctgcacaaatcttccagacattccccacgcggctgtgaatgctacactcggagatccgggaggacatatggcacaagactggctggagctgcggcagcacgacgaaaccggcatagaaacgatccgcgcgcactttgaagggcacgcctacgatccgcactggcatgacagctatctggtgggaatgacgctgaccggcacgcagcagtttcactgccgccgcgaacggcatcgcagtacaccgggggatgcctttttactggagcctggcgagatccacgacggcgacgcgccggtggcggggggctttacctatctgactttttatctggatgaacgctggctcgccgataccctgcgcgggctgtatgacgccgtgccttcgagctattcgctgcattttaaccgcaccattgcccgtgaaccggcgctcgtgcgggccatcgcgcagacgtttaccgcgctgcacagcgatgagatgcgcattctgcaacacagcaccatggacaatctgttaagccagctgacacagcactgccagtggcgcaaacggctgccggagcaggtgcagagcgcggccattgcccatcgcgcgcgggattatctgtatgcttttgtcggggagaatatcggccttgacgatctggcgcgggaaaccggcaccgatcgcttcacgctgacgcgctgttttaaacgggagtttcatctgtcgccccacgcctggctgatccagctgcggctggcgaaggcgcgggcgatgctggcgcagggggagcagcccgccagcgtggcggcggcgctcggttttgccgatcagagccatctcgggcgctggttccagcgtgcctaccggctgtcaccggcgcattaccgcaggctgtgcacaaatcttccagacccgcgcgcaaaataacgccacagtcagggcatcacttataaggagccctgcctgtgaatctgttgtctgcgtatctgccgtttatgctgtttgcctttgtggcgtccatcacgcccggcccgaccaatatcctcattctggccagcagccagcggtttggcgtcaaagccacgctgcctgccgtggcgggggcctgtctggcggcgagcctgattgtctttgtctccggcgcgggcgcgggggaggtgctgcgggattatccgctggtgcgtacggtgatgagctggatgggggcgctatggctaagctggatgagctggcaattgtttcgcgccccggcggcgcagtttgacgaggcgcagcggcccttcagcgccagatcggcggcgctgttacagttgatcaatcccaagacctggatgatggcgctggcggtggtgagcctgtttgcgccgcacggggcgcatccgctgcggaacatcaccctgttatcgctgttgtttttgctgatttcggtgatctgcctgagcgcctgggcgttgtccggcaatgcggttaaccggattttccgcactccggcggcgctgcgcggctttcagcgggcgatggcgctctgtctgttgctgtcagcctgggcgggtttgctgcactgagatcaggtcagcgcgccgccctgacggcactgggcgaaacgcagaatatcttcggccaggcgctgggcggtgtcgacatccgtctggctgcggttaaccagcatccggctgagacagccttccagcaccagctccatttgtttggcgaccataggcgcatcttcaatgccgatctttcgcagcagatcgtgcgagaactcataggccgcgcttttttgctgcgccgccagttgatggatcgggtgcgccggatccgggtaaaaggtacaggcggcgataaacaggcagccgggatagcggtgattcgcgacgcattcgctcagcgcgccatagcgggccagcaatttttgctcgaggctgaggtcgtcgttcagcagcagttgcctgcgccaggtatcgacctgcgtgctcagataacgcagcgcatcataaatcagcgcgtctttatcgggccagaagcgtaaaaattcatccagcggataattgatacgttcggcgatcatctctggcgtggtatcagcaatccctttaagttcaagtaattgcagagtgttccccaaaacatcttcgcgttgcacggtgtcctcctgcgttattgaaccgtttttcccattcacagtgtcgtttacggctggcgattgcgcaaatgctcagcgaaggccgcagcatccataaaacccgccacccgtaaggcggattgttcgttgccctgcgcatcaaagaacaggatcgtgggcagaccgggaacatgcagcgactttaataaagcagcatctgccgcggtgttcgccgtcacgttggcctgcaacagtacggtatctttcagcgcttcctgaacatgcggatcgctgaaggtgtacttttcaaactctttacaggccacgcaccagtcggcgtacagatcgagcatgactggtttgcccttcgcctgcgccagcgcctgatgcagcgcatccagatccgccactggcgtaaagttaaggtgcggcaggttctgcgcggcgcttacgccaaaggcccagtcctgcaacggcttcgcgcagatcagcgcgccgcccagcagaacaacctgcacgatgcgcacccacgccgcttttgccgtaaggctggtgataaacgcccagcagaaaaaggcgacgcccagcatcgaccacagccgcagcccccaggtatcgcccaggacacgctccagcaaaaacaccggcagagcgaggatcacaaagccaaaggcgattttaacctgctccatccatggcccgcttttcggcagcaggcggttgccaaagacggtgatcagtatcagcggcaggcccatgcccagtgcgtacagatagagcgtgccgccaccgagccagaggttgccactctgggcgatgtacagcaggatggcactgagcggcgcggtggtgcagggggagcaaatcagcccggcaatggcccccatcacgaagacgccgccgggtgagccgccctgctggcggttgctccacagcgttaagcgtgtttgcagcgcggaaggcagctgtaaggaaaacaggccgaacatcgacagcgccagcagggtaaagaggatcgccagcccgatcagcacgtaggggtgttgcagcgccgcctgaaactgcagcccggcggcagcgacgaccaggcccagcgcggtgtaggtcagcgccatgccctgcacataaatgaacgccagcagcagggcgcggcctgtgcgaaggcgctgtttgcctccgagcacgatgccggaaatcagcggatacatgggcagtacgcagggggtaaaggcgatgccgatgccgatcaacagcgcccagagggcggaaaagggcagttcaccggcggcggcaggctggctcgctgggagcggcgatgcaggcgttgcggcagctatttccgtcagcggcaccgttttggtttccggcggatagcacagcccggcctcggcgcagccctggtaagtcacggtgagcgtggcatttttacccgcggcattcaccgtcaccggcacatccaggcgctggcgatacacttcgcttttaccgaagaactcatcttcgtgcatctcgcccgcaggcagttgcggcggagcgatctccgcaccggcaggggtgattttgatctgctggcgatagaggtagtagccctctttcacctgccagtgcagcgtcaggtcgtgctggttttgctgaaaatcaaaggcaaaggcctggtcggcaggcacaaaactggaacggcccggggcgtcaaacagcccggcgaaggccgatgtgctgcacagcagcaggatcagcgtaaggaagcgttgagccatgagaggtaatcactatctccgtgtgtaaccggtaaaaccagtaattcaggggtctggtaagggtggtgcgatttcaggcaggcgagcagcgcctcctgatgcgcgagatcgcttttcagcagcatctgcacttcatattcctgctccagtttcccttcccagtaatagagcgaggtcgcgcccggcaacagggtgacacaggcggcgagtttatccgccaggactttggctgccagatcctgggcagtggcttcatccggggcggtacagagtacaacaacagcgtcaggcgtgttcatcgtcaatctcgactcggcgaaaacaggcactatagcaggtgacgggcggggattcatgcaacgggccgcgggacggcccgtttttaacgagatttacaacaggatgccgccgacgataaagccgaggatcacgcacagcgtgatggcaataacgccggggatcaaaaaggcatggttaaagacatatttgccgatacgggtggagccggtgtcgtccatttccaccgctgccagcagcgtcggataagtcggcagcacaaagagcgccgataccgccgcgaaagatgcaatggcggtcagcgggctgacgcccagcagcagggcggcaggcatcagcgctttggtggtcgccgcctgggagtagagcagcgtggcggcaaagaacagcaccaccgccagcatccacgggtagttatgcagcagatcgcccgccaccgtctgaatatcttcaatatgatgcttcacgaaagtgtcgcccagccaggccacgcccagtacgcagacgcaggcgctcatgccggatttaaaggtgctggcgttgaggatctcgccggtatcaattttacaggtcaggcagatgagcgtggcgatggtcagcataaacaccacaatggcttcgttacgcggcagcaccgggttggcgataagccctaccgtcgggctgatggcggtggcgtaaaccataaccgcgacgatgccgattaaaaacagcatcagcgaacgcttcgcatgaggtttgatgttaaacacctggctgccgcgcaggctgacttcgcctttcgccagtcgctcctgatacaccggatcgtctttcagctcgctgccgaggaagttacacaccacggcggtaagcatcaccgcaaccagcgtggtgggaatacaaatcgccagcagggtcagatagctgacgcccagcggttcaaggatgccggcaaagaacaccacggcggcggaaatcggcgaggcggtgatggcgatctgcgaggcgaccacggcgatggataatgggcgggacgggcggatgccctgttctttcgccacttcggtgatcaccggcagcgtggagaaggcggtgtgcccggtgcccgccagaatggtcataaaccaggtgaccagcggcgctaaaaaggtgatgtatttgggatgccgacgcagcattttttcggcgaggctgaccaggtaatccatgccgcctgcgacctgcatcgcggcgatggcggcgataaccgccatgatgatttcgataacgtcaaaggggatcgcgccaggcgggatttgaaaaaagagcgtcaatacgagtacgcccaatcctccggccagcccaatgccgatcccgccaagtcttgcccctaaataaatcgccagaaggacgataacaagttctgcaccaaacatagttgcctgccttgtttattaacaagttgatattagattgttgtattttagtaactcttaaaaagcaaaaaggcacgtcatctgacgtgcctttgtttgcgtggcgaacaattactgctcgctttcatcggtgtagcgtttggccttatagaccggatgcatcaggttatgcggcgagaagatgtcatccagttctgcttcagtcagcagaccgcgctccagcaccacttcccgtacgctcttaccggtctccgcacagatcttaccaacaatatcaccattgtggtggccgataaacggattgagataagtgacgatgccgatggagttgtaaacgtagctttcgcagacggcgcggttagcggtaatgccgttgatgcatttttccagaaggttgtaacaggcgttggtcaggatgtggatggattcaaacatcgcctggccaatcaccggctccatcacgttcagctgcaactgacccgcttcggaagccatggtcacggtggtgtcgttaccgatcaccttgaagcatacctggtttaccacttccggcaccaccgggttcactttggctggcatgatcgaggagcctgcctgcagttccggcaggttgatctcgttcagacctgcacgcggcccggaggagagcagacgcaggtcattacagattttggagagtttcaccgccagacgtttcagcgagctgtgcaccattacgtaagcgccgcagtcggaggtggcttcgatgagatcttccgccgggacgaccggcaggttactgacttccgccagcttctgcaccgccagctgctggtagccgtccggggtgttcagacgggtgccgatggcggttgcgccgaggttcacttccagcagcagttccgcagtacgacgcaggtttttggtctcttcgttcagcagcacgttaaaggcatggaactcctggcccagcgtcatcggcaccgcgtcctgcaactgggtgcggcccattttcagtacgtcctggaactcaacggctttattctggaagccttcgccgagctggtggatggcatcgatcagtttttcgatcgaagcgtataccgcgatacggaagccggtcggataggcgtcgttggtggactggcatttgttaacgtgatcgttcgggttgaggtactggtactcacctttctggtggcccatcagctcaaggccgatgttcgccagcacttcgttggtgttcatgttgacggaagtgcccgcgccgccctgataaacgtcaaccgggaactgatccatgcatttgccgttattcaggacttcatcacatgcggcgataatgacattagccacgttcttcgggatggtctgcaactccttgttggccattgctgccgctttcttaaccatcaccatgccgcgcacaaactcagggatgtcactgattttgctgttactaatgtaaaagttttcaatcgctctcagagtgtggacgccataataggcatccgctggtacttcccttgtgcccaacaaatcttcttcgatacgaatgttgtttaacatgtgaaccttcttaaattaaagctacgaatgaatgcaccaaacacacaggagatctgtggttatgtgtgattactgaccgacgattatttccttaatcagccacgtaaccgggatcatatgctgatcatagcgaattgccgtaacctggatcacttattatcttagctgatacggtacttttattgatttgtgaaatacatcaccggatcaatcattgccaaaaaatagtcgcgcattccgattgaattctggcatgaagcctccattacaggatcatgcgtgtcgcaaaattacactgaccgtggcgcgaaagccgcggtttacacaggagaagccagtgcgctggataccgttaattgccgtatttttatatgtttacattgagatttcgattttcattcaggtcgcccaggtcttaggcgtcctgttaacgctggtgctggtgatcttcagttccgtggtcgggatgtcgctggtgcgtaaccagggcttcaagaatttactgctgatgcagcagaaaatggcggcgggtgaaagtccggcagcagaaatgatcaagagcgtgtcgctgatcatcgccgggctgttgctgctgttgccgggcttctttaccgatttcctcggtttgttgctgctgttgccgccggtacagaaactgctgaccctgcgcctgatgccgcatctgcgtttttcccgtatgccggggggcggtttcagcgccggtacccagggcgggcagacctttgatggcgaataccagcgtaaagacgatcagcgtgaccgcctcgaacataaagacgatcaataattacttttgcccggtggcgctgcgcttaccgggcctacaaattacccgttccagcaattgtaggccgggcaagcacagcgccgcccggcatgtttaatccacgcgccgtttgggtaaaaacagccacagcgccgccagcatgatgatggcgtaaaggctcttccagccgaccatcgccagcagcagtaaacagagcaccccgccaagcgccgccagcgcacgataacgcccggtcagcagccgacatcccgccagcatacacagcagatagatcatgatgaaaatgccgttggcatagacaatcagcgcatccagattgatatccagcagatagatacccagcgtgctcagcatgcagcagccgatcaccgcgctgagggcgttacgcggaatgtggtttttcgaaaggcgcgccagatagctgtccggcaggtgctgcgcctgcgaccacaccagccgcgcgaagctctggatataaatgttcagactggcaaagcaggccagataaccaatgacgcaggcgatccacagggctttcacgccaaacagctgcacgacgatgcccggcaatgaagtcgcggcggcgcgatcggcgctgtaggcattaaaatgcagcaccagcacggtacaggcccagtatacggttcccgccagcagcaggccaatcatcagcgcgcggggaaaatcgcgctccggctgtttgaattctgacgccagatgcgcaaaagcctcaagcccgacgaagcaccagaacatcaccgacagcgcggcgaacagctgcggggtatccacctccggcagcgccgggaagggaatggccgcgagggtaatatcgccatagatccagatcgctacaatcagggcgacgatcaaaatcgccaccagggtttgcaggttggcgctggagcgcgcgccccgggagccaatccaccagatgatggcgagggtgcccagctccgccagcaataactggctgtcgtgccagccgaacagcgactgcccaaaaccggtggcgatgtgcagcgcggcgggtaatcccaccgggatcaccgacaaaaatagccagccggtgacgcgcgccagccgggggccaaaggccagggcgacaaaatgcgccacgccgcctgcgctgggaaaatgtcggccaagcagggcaaaaacaatggcgatgggaaacaccagcacgatcagcgcaggccaggcccacaggctattatcgcctgctaccagcgccgccagcgcaggaacggcaaacacgccggtgcctaataatgaagtagagagtaagcccaccccttgcgctaatcccaattcctgttttaatccgctcattaccctgtcctgccgccatcaaagagcggcgatagtagcataagcaggccttatcagcgccgcgtgttccctccccacttctggcaggacgttgtttcaggcaactttttatcgcccttaagaaaatttttttctttttgccccttgaaggcttgatcaagcacccccatctctgacgtcaccagccgggaaccacctttaggccggcgtcatccataaccgatactgactttctcaaaggagagctatcaatgagtattcgtccgttgcatgaccgtgtcatcgtcaagcgtaaagaagttgagtccaagtctgcgggcggcatcgtactgaccggaagcgctgctggtaaatcgactcgtggcgaaatcatcgctgtcggtaaaggccgcatcctggaaaacggtagcgtgcagccactggacgttaaagttggtgacatcgtcattttcaacgatggctacggtgtgaaatctgaaaagattgacgatcaagaagtgctgatcatgtccgaaagcgacattctggcaattgttgaagcgtaacccacccgcgaactgaacctacgaatttaagggaaagaagaaaatggcagctaaagacgtaaaattcggtaacgacgctcgtgtgaaaatgctgcgcggcgtaaacgtactggcagacgcagtgaaagttacccttggcccgaaaggccgtaacgttgttctggataaatctttcggtgcaccgaccattactaaagatggtgtttctgtagcacgtgaaatcgagctggaagacaagttcgaaaacatgggcgcgcagatggtgaaagaagttgcctctaaagcgaacgacgcggcaggcgacggtaccaccactgcaaccgtactggcacagtccatcatcaccgaaggcctgaaagctgtagcggctggcatgaacccgatggatctgaaacgcggcatcgacaaagcggttatcgctgcggttgaagaactgaaagccctgtctgtaccttgctctgattcccgtgccattgctcaggttggtaccatctccgctaactccgatgaaaccgtgggtaaactgatcgcggaagccatggagaaagtgggtaaagaaggcgttatcaccgttgaagaaggcaccggcctgcaggacgaactggacgtggtagaaggtatgcagttcgaccgtggctacctgtccccgtatttcatcaacaagccggaaactggctccatcgaactggaaagcccgttcatcctgctggctgataaaaaaatctctaacatccgcgaaatgctgccagtactggaagccgttgcgaaagccggtaaaccactgctgatcatcgctgaagatgtggaaggcgaagcgctggcgaccctggtggttaacaccatgcgcggcatcgtgaaagtcgctgcggttaaagcaccgggcttcggcgaccgtcgtaaagctatgctgcaggatatcgctatcctgaccggcggtaccgtgatctctgaagagatcggtatggagctggaaaaagccaccctggaagacctgggtcaggctaaacgcgttgtgatcaacaaagacaccaccaccatcatcgatggcgtgggtgaagaagcgagcattcagggccgtgtttctcagatccgtcagcagatcgaagaagcgacctctgactacgatcgtgaaaaactgcaggagcgcgtagcgaaactggctggcggcgttgcggttatcaaagtcggtgctgctaccgaagttgaaatgaaagagaagaaagcccgggtagaagatgccctgcacgcaacccgtgctgcggttgaagaaggtgtggttgcaggcggtggcgttgcgctgatccgtgttgcttctaaactgagcgaactgcgtggccagaacgaagatcagaacgtcggtatcaaagttgcgctgcgcgcaatggaagcaccgctgcgtcagatcgtgctgaactgcggcgaagagccgtcagttgtggctaacactgttaaaggcggcgacggtaactacggttacaacgcagcaaccgaagaatacggcaacatgatcgacatgggtatcctggatccgactaaagtgacccgttctgctctgcagtacgcggcctctgttgccggtctgatgatcaccaccgagtgcatggtgaccgacctgccgaaagccgatggccctgatttaggcgctgctggcggtatgggcggcatgggtggtatgggcggcatgatgtaatcatgttgttctgcatcccgcagaaataagaaaacccccgggcagcaatgtccgggggtttttctttgcgcggcgtataacttctctaaatatatatcattattataatattggatttgtgattattaacagatgaacccataattccaggaacatattttgacaaacacagaaatgccaacaaaatgaatgtgctaactcattattttaaggatgttcttaaattaaagtgagtgctacggtaaattcatatattctgaaatgattcatattgtctataacattttatgttaatatacgcatccttcatgctaataaccttttgcagctaataatatgcgtttgcttatttataccactcgcaaatatattcaggagaagggatgcaatgaaaacgaattatctcgccatgtgcgtcgcgctggcgttgggcagcacggcgcacgcgaatgcgctttacgattataccagcggtaataacggcaacatttatgaatattacaatggtggcggatcggctgaaatgaaaatttcagggagtgtgacttatgatagccgcgtcgacaccgacgtcgacaataacaatataggtatctatttcggccggaacgttcccgattccgaagaacccggaatacttattatgaatgttgactcggcgaatattgaattagatgaaacccaaataggtatctacactgggggcgacgatggcggtggcgctatagtgaatgttaacgatagcgtaatgaatattaccagtgataacgattatgcggcaggtattgacatcgctgatgataaaattgcggagttacacattgataatactgcttctgatattacgctgacgggtactggtagcatcggtattactgcctacggctatcagtctttgacggtagatattgactctccggatttattcattaatgttggcgacgcgtctgcgggcaatagtattggcataaaagccgaggcattaggggcattcgcttcagagccagctaacacaaatatagctttggatgtgctggccaacatcaatgtgcagggctttaatgcaatcggtatgtccgcttatgcagcggaaggtcaaaataataatgtggcaattaacagttcaggggtaattactgcgcagggaacgggggcaaaaggtattcaggcccaagtctataacgatgttctcaacgacggtaatagcggtattaccattgacaccttagatctgcaattaaccgcttccggggaaggggcgcagggtattaacgcattcagtgaaaatagcggcgatattgttattaatcttgggggcaatacccagaccagcggcggttggggagcggatgccacgggcgtcagcgccaccagccagaaggccgtgacgatgagcatcgacgacaccgccacgctcggcgcgatgaatgacagcgcgatggttattaccgcgccgacggtgacggtcaacaacaagggcacgctcactggtaatctgaccctcagcggcgatgacgtcaccctgaataacagcggcaacctgcatttacgcaattggcaggatactgacggcgacggtacacgcgataccaaagccgtggcggtgtccagttttggcggcaacggggtatttaacaacaccggcacaatcgtgctcgacagcgtggcagacagcgacatcaccagcaccaacacctcaaaggaatatgccacgggttacagcgttaacagcaccagcaacgacggcattatgcaggcgcaactgctgggcctcagcacctttaccaacagcggcaccattgatatgagcgctaatgataaagcgggggatacgctcgttatcagcagcagcactgacgccggggttgccggtaacagtacgtatgtctccaatggcggcaccatcgccatggatgtggtgctcaacgaaggtggcgcgaattcgcagagcgatatgctgattgtcgataacgtcgaaatgggcagcgcgaaaaccgatctgctgtttaccaataccggcagcgacagcgatgcggcgttgaccaccggcgacggtattaaagtggtggatgtgcgcggcaacacgtcggaagatgcctttgaactggcggggcaaactcacaccatgagcgccgggcagtatatttatcgtctggagcagaataccgccgataccgactggtatctggtaagcgatgaggcaaatcctgaaccagcgccggatcctgagccgacgccggagcccgaacccacgcccgagccaacccccaatcctgatcccacccccgatccgacaccagatccggatcccgccccttcaccagacaatggtgatgacaatgggtcgatgatccgcccggaagtggccggttatctggcgaaccagacggcggcagtcgatatgatgatccagacataccacgatcgctatgatggacaacagccgggtggtgaaggcgcgcctgcgctctggggacgcattaccggcggccagtccagccacaacagcgctggcggccagttcgatgtcgatcaggaaagcgttcgcgtccagctgggcggcgatctcgtacgcctgaccagcaacggcagcgatgatatacgttttggcgtgatgggcagctggcagcgcagcgatgcagacagtgataaatactatcgcgtcagcgatggcgcaggaaaaacgcgctttaacatggacgcgagcgtggaaggttacagcgttggcctctatgggacatggctgagcgacgtgaaacagccggagcacttctatgtcgacagctggctgcagtacggctggtacgataacagcgtcagcagcaggcagtccggcgttggtgatgatgagtacgactccagcgtctggagcggttcgctggaagcgggttatggcgttgtgctgtcggaaaatgccgcgcagcaaagccaggtgatcctgcaaccacaggcgcagatcatttacagcgcctacgatgctgacagccacagcgacggcgcgggtatgtccgtcagcggctacgatgccgacggcgtaaccagtcgccttggggtgcgtctgtggcggcaaagcccgcagcaggtggtgcagccctttatggaaatcaactggtggcacggcacggcggataacagcctggaaattgataacacccgctatgacgatgatacgccagctgaccgctatgaaatgaagatgggcctgtccggcaatattacgccgggactgaaggcgtggggcagcctggcaatggctaccggcgataacagctatgacagctacggcggcatgattggcgtaaaatacagcttctgacgtgatatgaccgacaaacccccggacagaaatgcctgggggtttttcttttggtcatctttttagtataaggttcagacacggacaacgttgtccagctattacacgaggaataacatgcgcgtttacgtcggtgcagggattgtcggtgcagcgttgctgctggcgggttgtagcgccagcaacgatctgaccgctggtgggcaaagcgttcgttttgttgaagaaaaaccgagtgagcagtgtcgtttactgggcaccgcaaccggtacgcaaagcaactggttgtcgggtcagcatggcgaagagggtggctcaatgcgcggcgcggcaaatgccctgcgtaacgaagcggcaaaaatgggcggcaacgtgattttcaacgtcagcagcccgacccagggatttatgtcgagcttcgtgccgaccgccagcgaaatgagcggtcaggtgtataagtgcccgaactgatcgccggcatcttctaagatgaaccccgctccggggttcactgttttcaggccgccgatttctccacatgtaaccgcagattatgcaccgcatgcaggcactgcgcctgtgtcagcgtgaccttatttcccgccgccagtgttctgacaaataccttgcagggtgtgtgatccagcttgcgcaggcgattgctgaaacgcagcagacgtttaacgatgccctgggtttcttgtgacgcggaaggggatcgcgttttaatgaccgagccgctggtatgtatttctcctgcggtatttttatactgatagatcacgaccagatgatgggtgaacaggcggtatttccactcaggatgctgataagcgtcgtattccagctgcgcgttatcccggctgtcaacgtcatacagcggcaggaaatccagcacagaagacacgctttccaccagcgctcgtagcccggcattgttcattgcatgaataatcagtttcaccagcgccgggatttgcgtatccgcaatattcagggtcagcgtctcgcccgtattcagggtgaaggctatcgtcaggctgttgcctgtatcatcaagtagcgtaacgccttccacccgcaggcgcacatccgcatttctcagttcatcttcgaccagcgccggcgcgttgctgtgcagcgtgctgccagcgtcatcgggtacgcttttcacgggaagatgatattcaagacacagcagcagatctttcaggggtaacagcggaagaaacagcaggctgtcattattcgcctcgtgtttaattttcagggccagcgcagcaaaatcattgtcatgacgaataacgccagcgttcagtccatgaatagttaagggcatttatattctccatgaggggcggcaatataccggatgaagggcacagatttggcaagaaaacgcggggcagtataaggggagatgaggggtaaaaagagtccgaatgcggactcttaaagaaggcttattgctggcgcaattgcagatccagcggtgttttactcggctcgccgccgatttcacgcgccaggcgcggcaccatatagccggataccagggtcagcaattcacgcacgatctgacgcgcgtcctcgtcgctcaccataaaatgcgccgcgccctggactttatccagtacgtgcaggtaatagggcatcacacccgcatcaaacagggcattgctgagatccgccagcgtctgcgcgttgtcgttcacgccgcgcagcagcacgctctgattaagcagcgtgacgcccgcctgccgcagctgcgtcatggccgcgcggaaagcgtcgtcaatttcccgggcatggttgatatggttcaccagcaggatctgcaatgaggatcgcgccaggcgggccgccagcgtatcggtaatgcgcgccgggatcactaccggcaggcggctgtgaatgcgcagacgcttaatatgcgggatcgcctccagctcgccgatcagccagtccagctcatgatctttcgccatcagcggatcgccaccggaaaaaatgatctcatccagctccggatgcagcgcaatataatcgagcgcggcctgccagttgcgcttattgccctgattatcggcgtacgggaagtggcggcggaagcaatagcggcaatttaccgcgcagccgcccttaacaagcagcagcgcccggttacggtatttatgcagcaatcccggcaccacgctgtgctgttcttcgagcggatcggtggtaaagccgggggcggcgataaactcttcctgcgcggtaagtacctgacgcaacagcggatcgttcgggttgcctttttccatgcgcgccgcaaatgcgcgggggacgcgcagggcgaacagccgacgggcttcgcgtcccgcgagcagctctgcgctggcgtctatatttaaaagctgcagaagttcatcaggatcggttattacatcggcaagttgcaataaccattcttctctggaaggggtgtttagggttacaatgtgtgccattttttggctaataccagttaacaatatttcagagggccttatggcgacttactatagcaacgattttcgtgccggtcttaaaatcatgttcgaaggcgaaccttacgcggtggaatccagtgaattcgttaagccgggtaaaggtcaggcgttcgcacgcgttaagctgcgccgtctgctgaccggtactcgcgttgagaaaaccttcaaatccaccgattccgctgaaggcgctgacgttatcgatatgaacctgacttacctgtacaacgacggtgagttctggcacttcatgaacaacgaaaccttcgaacagctgtctgcggacgctaaagctatcggcgacagcgccaaatggctgctggatcaggctgaatgcatcgtgaccctgtggaacggtcagccgatcgcggtaactccgccgaacttcgttgaactggaaatcgtggaaaccgatccaggcctgaaaggcgataccgccggtaccggtggtaaacctgccaaactgagcacgggcgccgtggttaaagtgccgctgttcgtacagaccggcgaagtcatcaaagtggacacccgctctggcgaatacgtttcccgcgttaagtaattcctgccttatcttcagcggcgtggcgcaatgccaggccgctgacttcaaatcttcctaaaatatcgcctttttctccatagcccggaattttgtctatgcttaacaggctatacacaaataacactggctataaaaggaatatattatggttaagaaaacaattgctgcgatcttttcggtactggttctttcttctgtgttgaccgcgtgtaacaccacgcgtggcgtaggcgaagatatttctgatggcggcagcgcgatctctggtgcagccactaaagctcagcagtaacagcagcatacggtacggcctctgccgtaccgttgcttccgctttccggcagtgacaaaaacggcgtaaaacgattccccatgcccagcttcatgcggatatttcgtttataggtataaaccgttttgccattaataccgagccggtgagcgatacaatggttattagtgccgtccatccacagtgataatactttctcttcctgccgcgtcagcagcggtgtcaccgtctgattcacatcttctgtcggccgtgagcacagcgccccgttaatgctgcgagcaagtgcgtcaagcggtacagacttatctaatcgaccccagagcgggaactgctggcaatagctttccatctgcgcatcatgcccggacgataataacagcaacgggctttggctacagatgtgtaataacgaggctaattgctgcacgtgatgtaattcactcgcaaaaccatagagatcggcaatcaccagatccggctgccactgggcggcatgttctttggccagcattaaattgttcagcccggttaccagcaccggtcccggaaagatctcactttgattgagccagctctcaagcccgaagcgggtgaagcaacaacggtcaatcaataaaattttgaacatgtttggtttcgcagtcagaatgggtgacggctttcatttatctgaaagtacaccatcatagtgggaagacaaaaaagataaatgacggaactccgctgcgaactgcgcctatttcttgctttaagccgttaaaattttggataaataaaaaagttgaaatagtaaagtctggcggtaagaatacgcttctacataagccttgcaggacgacctgtaagcgccatcttcaacggggacggccccatctcaggagccaactatgtcctggttcgttttacttattgcgggtttacttgaagttgtctgggccatcggcctgaaatacacccatggtttcacccgtctcacgcccagtatcatcaccgtcagcgccatgatcgtcagtattgttatgctgtcgtgggcgatgaaaacgctgccggtcggcaccgcgtatgcgatctggacgggaattggcgcggtcggcgcgtccattaccggcatgatattgctgggtgaatccacaagcccggcgcgcatcatcagcctggtgctgattgtcgccgggatcatcgggttaaaactcagcacccattaacggttttgcgccacccagatgagtttctccaccgcaaagccctgttgttttgcggtgttcaccagatcctgtttcacgttatccggaatagtgcgggtgcgggacaggatccacaggtaatcgcgatccggcccgcagaccagcgcatggcgataatctttgtcgagcgcaatgacgttatagccgccgtaaaaagggccgaaaaacgacaccttcagcgccgcacggtttttagatcccgtaaagtaagcccggccatccgtcgattgccacataccccgcgacgggttatagcctttgttaataacgttcagcccgccgtcttcccgcaggctgtaggtggcggtgacgttatccagcccgcgctcaaaacggtgatccagacgggcgatttcataccaggtaccgagatagcgcgtggtattaaaattttccacgacggttacgccgggaggaggagtgggagactggcaggccaccatcagaagcgcggcggaaacgacggcaacgacaggcaatatacgcatggtattttccttccaggatttacagataagtgtaaagcgtcactggaattttgcccggcttgccgttgcgaagcgtgaccgggtctgcaacatcagacccggcactgtacttaaaggaaaattaccccgaccagcgtcaccacgctcaggatcgcggcaaggccgtagaacacccatttaccgtttggcacgtggatcttcaggtcgtgcatcaggtgatggatgcggtgcaggccgcaccacagcggcagcacaatcatcaggaagataaaggcgcgtccgatgaggctttgggcaaaggccagcacccgctcgaagctgagcgcgtcgccgggatacaaccccagcggcagcagcacgccgatcagcagcacgatgaccggcgcaaagaacgcgccccacatgccgcctgcgccaaacagcccccagaaaacaggttcgtcagagcgttgtggatttggattaatcattctggcctccttaccagtacagggcgacaaacagcaccaccagcgtcaccagcgccgtgacaacccacagccctttgatgatcggctgcggtcccattttctcgtctttgacgatgatattcgcggctttcggtgccaactcaaaccaggttttggtgtgcagcaacgcccccgccagcgtgatgaggttaaggatcaccaccaccgggttttgcaggaagcccacaaatcccgcccaactttctgcgccatgcttcagcgcaaacaggccataaatcagcacgatgctgaaccacacggtagtgattgccgtgccttcgcgcagcatataaaagcgataaaacggcaggtttttccaccagtttgacggcaccggccgcacgtaaggtttacgtttcgttgtcatcatgcgctccttagcgtggtttcagggtggcgataagaaagtctttcgaactttccactttcccctgctgaatggccgccgccggatcgacgtgcttcggacaaacgacagagcagtagcccacaaacgtacagctccagacgccgttctggctgttaagctgcgccatacgctctttcttgccgcgatcgcggctgtcttcgttataccggtgcgccagggtgatcgctgccgggccgataaattccgggttcagtccaaactgcggacaagcggcgtagcacagaccgcagttgatgcagccggagaactgatggtatttcgccatctgcgccggcgtctgggtgttcggcccctgatccggtgtacgcggattgccgataatgtagggtttaatggcttccaggctctcgataaagtgcgtcatatcgaccaccagatcgcgttcaatcgggaagttcgccagcgcctccaccttcatgccttgttcgtattcgcgcaggaaggttttacaggccagctttggcaccttgttgaccatcatgccgcaggagccgcaaatcgccatgcggcacgaccagcggtagctgagatccggcgcgaggttatccttgatatagcccagcgcgtccagcagcgaggtttgctcatcaaagggcacctcgtaaaacgcgctgtgaggggcgctgtccacttccgggttatagcgcaccacctcgattttcagggtttgtagctcagccattcgccttctccttcttctcggctgcttccgcttcgccgccgtacatgcgtttcgccggcggcagcgtggtgatcttcacgtcgctgtattccagacgcgtcgtgccgtcagcatcgcgataagcgagcgtatgtttgaggaagttgacgtcatcgcgttcggtgcagccttcgtccagacgctgatgcgcgccgcgcgactctttacgcgccatcgccgagtgcgccatacactccgccacgttcaggccatgcttcagctcaagggtatacagcagatcggtatttaacacactggaggtgtcggtgatgcgcacgcgtttgaagcgctcctgcaactccgccagcttatcgatggttttctgcatcagttccggcgtacggtagatgccgcagccttcttccatcgccatgcccatttcgtcgcgcagatgcgcccagttttcactgccttcctggttaacgagatctttcaggcgctgttccacatcaccggcctgggcgttcagcgccttatcgtcaggctgatgtgcgcccatggcatgttccatggctttttcaccggcgaggcggccaaagaccaccagttcggccagcgagttcgagccaagacggttcgcgccgtgcagcccgacagaggagcattcgcccaccgcgaacaggcctttgatgcgggtttcgcagttttgatcggtttcgatgccgcccatggtgtagtgcgcggtcgggcgtaccgggatcggatctttcaccggatcgacgccgacatacgctttggcaagctcacagataaacggcagacgttcgagcagctttttctcacccagatggcggagatccagatggatcacgtcgccgcgtggcgtcgaaatggtgttgcccttgcgccactcatgccagaaggcctgggagactttatcgcgcggccccagctccatatatttgtttttcggctcgccgaggggcgtttccgggcccatgccgtaatcctgcagataacggtaaccatctttattcaccaggataccgccttcgccacggcagccttcggtcatcagaatgccggaacccggcaggccggtcgggtggtactgtacaaactccatgtcgcgcagcgccacgccgtggttcagcgcaatgcccatgccgtcgccggtgacgatgccgccgttagtgttgaagcggtacacgcgcccggcaccgccggtggccatgatcaccgcattggcgcggatctgcaccagcgacccttccatcatattcatggcgacaaggccgcgcaccgcgccgtcatccaccagtacatcgaggacaaaatgctcgtcaaagcgctggatctgcggaaactgcaacgaggtctggaagagggtgtgcagcatgtggaagccggttttgtcggcggcaaaccaggtgcgctcaatcttcatgccgccgaagcgccgcacgttgacggaaccatccgggcggcggctccacgggcagccccactgttcaagctggatcatttcggtcgggcaatggtgcacgaaataatccaccacatcctgctcgcaaagccagtctccaccggcgacggtgtcgtgaaaatggtaatcgaagctgtcatgatcctgcgcgacggcggcagaccccccttcggcggccacggtatggctgcgcatggggtacacttttgagatcagggcgattttagcgttgggattcgcttgcgccgcggctatcgcggcacgtaatcccgcaccacctgcgccaattacggcaagatcggcttgaaaggtttgcacgacattcctccaggttttagttattccgcgtcgcccttaacaggcgtcgcaaaagcatgtccactgctccattatggggaggcagtataaccttgcgggaggaagggaaatttgatgcgttcgatttttttgccgatcttccgcgtgatttatcactctgtttgatggatccggccctttgtcttatttgtccgccgcgggcaataaattactgtgcaaaatttgtctctctggcgggttacgggtagacttcgtgcccttatcagcatacggagaattaccatgagcgagacggcaacctggcagccgagcgcgtccatccccaatttattgaaacgcgccgcgaagattgcggagatccgccgtttctttgccgaccgcggtgtactggaggtggaaacgccctgcatgagtcaggcgacggtgacggatattcatctgttcccgttcgaaacccgttttgtaggccccggccattctcaggggatgaacctctatctgatgaccagcccggaataccatatgaagcgtctgctggtggcgggctgcggtccggtgttccagctgtgtcgcagcttccgcaatgaagagatggggcgtcaccacaatccggaattcaccatgctggaatggtatcgtccgcattacgacatgtaccgcctgatgaatgaagtggacgatctgctgcaacaggtccttgagtgcccggcagcagaatccctgtcttatcagcaggctttccagcgccatcttgaaatcgatccgctctctgccgataagcaacagctgcgcgacgcggcggcgaagctggatctgagcaatattgcggacacggaagacgatcgcgacacgctgctgcaattgctgtttaccatgggcgtcgagccgcacattggtaaagatcgcccggcctttgtctatcacttcccggcaagccaggctgcgctggcgcaaatcagcactgaagatcaccgcgtggcggaacgctttgaggtctatttcaaagggcttgagctggcgaatggtttccacgagctgaccgacgcccgtgaacagcagcaacgctttgagcaggataaccgcaagcgcgccgcccgcggcctgccgcagcagcccattgatgtgaatctgctggaagcgctgaaagtaggaatgccggattgctccggcgtggcgctgggcgttgaccgcctgatcatgctggcactgggcgcggaaaacttaagtgaagtgatcgcctttaccgtcgacagagcgtaaggcttaacggtcccggccctctttctgaaaagagagccggggtgaggggattacaaacttcccgccgggcggccacgtccggcagaggtcagcgttctgtttgttgctttaccgcccagggtttccagacgcatctggaatggcgggaacggcatatcaataccgtgttcacggaagcccgccaggatcaactgatggatctcatggcgcagcggcatccggtgtcccatctccgcagcgtaaatacgcagttcaaacagctgaatgccctgctgtaaatccaccaggaacacttcgggcggcgggttatcgatcaccagcgagcagcgttccgcggcggtatatagcaactgcgtcacttcctcactattggcatccgccggagcaggcaccgtcagcaccacacgggttaccgaatccgacagcgaccagttgatgaactgctcggtgataaacgccttgttcggcacgatgatctctttgcgatcccagtcgctgatcgtcgtggcgcgggtattgattttggtgatgctgccggtcagatcgcggatcgttacggtatcgccgatgcggatgggtttttcgaacagaatgatcaggcccgagatgaagttggcgaaaatctcctgcaaaccaaacccgagcccgacaccgagcgcggccaccagccactgcaattttgaccactcaataccaatcatcgagaagcccaccagaccgccaaacagcatcagcagatatttggtgatggtggtaatggcgtagccggtgcccggcgtcagatcgaggtgctgcaacagcgccagctccagcagggcagggaggttacgcaccagctgcgtggtgatgataaacaccagaatcgcgatcagcaccgcgccaagggtaatcggctccagactttccacgccctgcacggtggaggtcacatcccacagggaaatattctccaggaagccaaacgcggagtggatttccgaccacagcacaatcaccgacagcagggcgatcagcatcaggatggagcgcaccaggcgcagcgactgggtactgatggtatccagatccacttcgctctcgtccacttccaccaggccttcggtgctggtggtgtgatgcggatcttcttcaccccgggcacgctgggcgaggatctcggcgcggcggtgtttagcgcgatcaaaggccagccgacgacgctggatcagcatccagcggcgaatgatgtgatacaccaccagcagcaggaaccagatggccaccgaggtctccagccgcgccagcagtgcctgcgctgtcgccagataaccgaccatagccgccagcatcgccaccagcggggcgctcagcagcaggttccacagcagatggttgcccatgttgtcactgctgccggttttgtcgacatacaacgggatcccggcgcgtttcaggctcagggtgaccatcgccagcgcgccgcaaatcagcataaagcacagtcgtccgagggagccggagaactcacggtcattaagattatcgaacatgatcagcgccataatcagcggcacgatcaggccaatacacagcaaatagttgcgcataccgcgcgccacacgcgcccgcggccacgcaaaatgcgcgacaaacagaccgttggggcgggcaaaggtggcgcaaatcatcaccgcccacagcatcggcacggtcgcggtgacgccatcgccaatcgccaccgccagcggatacggccaggcctcacgcaaaccataacccagggtagcccacagcaccggcagcggcgaggccaccagaatcgaccagaataccgtgcgcagcgtcagccagaagtgatcctgagtcaccttgccgacgcgggcggacgaacgctccagaaagcgggtaaagtgcttacgcgagtacaggctgaagccgacaaggaacagggcggcaaacagcggcagcagcgtttctttggtggtcagcatcatcagcgtggccttgcccagctggctgaaggtatccagcgagatcagacggcgcagatcctgcacgatatcgatcggccagctgagattgatagggctgacgtccgaggtccagaacaggtaacggtgcgtcgcctcgttcacctctttcagcgcgtcttccagctgcgtgtgcgacaccttgagcttggtgagttcaaggatcagcgtgtcgccgccctgcaacagcgaagtcagcagctcgcgctgagtacgcagttgggcgtcaagaatacggctttgttcgcgggtcagcggctgaccatcgacctgacggatctgccgcagttgcggctgcttgttcagcagatcttcatagcgcatacggtgcacgcgcagctgcgccatttcggtgtccagctgctgtggtttcggcatttccggcagacgggcgacctgcgcacgcagcgcttcgccaagcatgttggatgcccccagccactgggactgctcgcgcagggtattgagcgcctggcgtacctgtaacgtctgaccggtggcctgtcgttgctgagaggcgaccagatccatccgctgcgcctgctggttgagcgcctgggagagttcgcggttgattttaaactgatcgacaatgccgaccggcaggttggcgctgttttccgccagcatttcggtgctttccagcgcctgctcggcttcacgctgccgctggctgttgagctgattacgcagcgcctgtaagtaagtatccagctgcgccgcctgcttttgcgccagctcggagcgcatacgcgccagttcctggcggttgttggcggacagttgcgccagctccagttcatccaccagcgctttcagcctggcagattccgcctgagcactgagcagctgcgcctgggccagcgcggtggtaccggctggcgtaccggcgcggcgttccacctcattgagctggcggcgggcatcggtttgctgctgcggcagctggcttaaggaatcgctgatttcacgggcgcgctcctgctcctgctgcgccaggcgcgtcttatccagcagctggctgctgacctgcaaaatttcctgattgagggcgtcagaactcaggtcggtgggaatggcgcgcggctcgtcgcgcatactgttcagctgtgcgcgtaaggtctgggaggttttggcgaagtcgtcaatgacctgctgatactgctttgcgcgctcaagcgagccgttacgctcgtcgagcgcgttcagcgcggcctggagcacctcaacggtttcggcctgatccggggcgtttttcgcccctttagcctgctccagttcctgcgcgatttgtttagcgtcgggggccgtcgcagcggacgcccccatactgagactgaggcaccaggccatcagaaaagcgataatcaggcgcacatcagttaccttttaaaatcagacagggtctttcttgtcgtccaccagcgggttggcgtcgtgctcggcgtcgatctcttcctgcggcagcggggtcggctccggcatcacaatggcctcggtggagaccgccagcggttcgccgattttggttaccgacaggctttgcagctgttcaaccagttccactttgcccggcgcgaacaggttaatcaccgtagagccaagcttaaagcggcccatttcctggcctttcagcagggcgacagcgccatcgctttcacccgcgggccaggtccagcgtttgatgatgccttcgcgcggcggtgtgacggtgcccgcccagacggtttcgatgctgccaacgatagtcgcgccgaccaggatctgcgccatcgggccgaactcggtatcaaacaggcagatcacgcgctcgttacgggcaaataagtttggcacattgcgcgcggtcaggtggttgaccgagaaaagatcgcccggcacgtagatcatctcacgcagaataccgttacacggcatatggacgcggtgatagtcgcgcggcgacaggtaagtggtgacaaaggagccgttgcggaacagatccgccatcaggtaattcccggccagcagcgcttcaaggctgtagttatggccttttgcctgcaacagtttgtcgttttcgatgctgcccagttggctgatcacgccgtcggcaggcatcaccagcacgttcggatcggtattgagcggacgcacttcatcacgcagcgggcggacaaagaagtcgttaaaggtgcgatagctggcggtatccggcttttgcgcctcgttcatatcgaccttgtagtatttgacgaacagatcgataaccagtttggtcagccagcctgcgcgttttcttgcgccccagcccgcgaggcgagtcagccacagtttaggcagaatgtattgaagcgaaagtttaaatgagtctaacaaggtagcctccaggctaatattttttaccgttcccgatccgcgtattaccggcggatcttttaaaagggtgacaattctggcgatgcttagcttaaatgtcagctatcggtatcagaaaagtttttacgcgtttttacctgcgacatgctttccagaatgcgatgataattttcgaagcgtgattcggcgattttaccttgctcaaccgcctcgcggatagcgcatcccggatcggtatcgtgcttgcagtcgcgatatttgcagtggcctaaataatcgtggaagtcgataaagccccgggtaacctgctcaggctccagatgccacagaccgaactcacgtacgccaggagagtcaataacgtcgccgccgtgcgggaaatggtacaggcgtgaggcggtggtggtgtgctgaccaagaccggagttatcagagacgtcgttaacgaggatctccgtcggcaggcctaacagcgaattcagcaggctggatttgcccacgccagactgcccggcaaagatgctgatacgatcggtcagcgcctcttccagcggtttcaggccgtcctgggtgtagctggacaccatcagtacgcgataaccaatgtggcgatagatatccatctgctcattcacaaacgccatgccttctgcatccagcaggtcgattttattcagcacgatgatgggttcaacgtccagggtttcgcatgccaccaggtagcggtcgatgatgttaagcgacagctccggcaggatagccgagacgatgacaatctgattgatgttcgccgcgatgggttttaccccgtcgtaaaagtccgggcgcgtcagaacggaagtgcgctcatgcaccgcctcgacgatccctttcacgttaacgccttccgcggcggctttacccggacgccagacaacgcggtcgccagtgaccagcgaacgaatcgtgcgacgaatgttacagcggtgggtttcaccgtctgcggattccacgtcggcatgcatgccaaaacggctgattacgatgccttcagccgcttcgccaaacaggttgtcgtcaaggtccggtttctccacagacgtttttagccgccgctggtgattggcgttgacgcggcgctgctggcctttggagagtttatttttactcaatcgtgctgactcctggtcgcccctgatgggcaaaacctctatgatacacgctattttatactagttaaccagatgtggctggttatgcgagaagggtggaaaatagcatgagtgcaaatgaaaacaacctcatttggatcgatctggaaatgaccggcctcgatccagagcgcgatcgaatcatcgaaatcgcgacgctggtcaccgatgcgaacctgaacattctggcagaaggcccggttatcgccgtgcaccagtcagatgaacagctggcgctgatggatgactggaacgtgcgtacccataccggcagtggtctggtggatcgcgtgaaggccagcacccaggacgatcgcgccgcagagctggcgacgattgagttcctgaaacagtgggtgccggcaggcacatcgccgatttgcggtaacagtatcggccaggatcgccgtttcctgtttaaatacatgccggagctggaagcgtatttccattaccgctatctggacgtcagcaccctgaaagagctggctaagcgctggaagccggaggtgctggccggcctgaaaaagcaaaacacgcatcaggcgctggatgatatccgcgaatcggtcgcggaactggcctattaccgcgagcatttcatcaagctgtaacttttttttggcccctgtctttcgcaggcgaggggccataatgcggattttgatgggaaaataatcatcttgccgattaaagcagcacttgaacaaaaaatttaaatttttcagtttcagggcttgcagctaaaatgaattctcgtataatgcgcctcccgtaccgatgcagaaattgcaaagttacgcagagcgggaatagctcagttggtagagcacgaccttgccaaggtcggggtcgcgagttcgagtctcgtttcccgctccaaaatttgaaatggcttttaaagccgcgcagtatccagattcaaggatttcatgttgcaaccaggcagcctgaaagacgacgaatatgcgggaatagctcagttggtagagcacgaccttgccaaggtcggggtcgcgagttcgagtctcgtttcccgctccaaaatttgattggctttttacagccacgcaccacccaagcgggaatagctcagttggtagagcacgaccttgccaaggtcggggtcgcgagttcgagtctcgtttcccgctccaaatttcttctctgaataaattatccacagcgggatcccttgccgcagacgatttgtttcctctttgacatattcttgtgaacagacttatccacaggtttgttatttctgcctgtcccggtaaatgattcaggatgtgaatgaatttatgataactgcctgatatgtttcacaaaaatttcatttcaaaatgttaatcctgtcccttgacgaacttctccgccttgattagcaatgtttttttatttttatgcacaagctgtggaaaggtcaggcgtcgcgtttcagccctttttcgattacccgcaccagccgcaatttctgcggtaattgcacctcgacaacacaggcattccgcttatcaatttgctgcgcaatcgcccattctatgtgctcatcaagaagtgggtgctcacctctgcgctgttccagcgcgcgaatgttagcttcatcccagggcgcgttccccagcgcgacggcgatatttctcagccagcgtaaatgaccgatacggcggatcgccgatccttcggtgactttcaggaagtgggcttcgctccagccgaacagcgtaataagctcaggcgcgtgcagcgctttgcgcgggctgaagtcctcttcgtccgtcagttgcgagtagcggttccacgggcagatcaactgacagtcgtcgcagccgtagatgcggttgcccatcaaggggcgaaattcttccgggatcgcgccttccagctcaatcgtcaggtaagagatacagcggcgcgcgtcgacggtatagggctcgacaatcgcgccggtcggacagatggtcatgcaggccacgcatttaccgcagccttcttccaccggctgatcaaccggcagcggcaaatcgatcagcagctcgccaaggaagaaaaacgaaccggcttcgcgattaagaataagtgagtgcttacctgtccagccaagcccggctttttccgccagcgggcgttcaagaatgggcgcagaatccacaaagggtctaaaattcaacgatgcgcactgttcctggatcttttcaccgagcttttttaagcggttacgcaataacttatggtaatcgcggcccagcgcatagcgactgacatagcccagcgacgggtttttcagcgtgctggcgaaggcggcgttagcgggcaggtaattcatgcgcacgctgatcacgcgcagcgtaccgggtaaaagctcatgcggacgggcgcgcatcataccgtgacgcgccatccagtccatttcgccgtgatattgcttatccagccatgcctgcagtttgggttcggcggcggtgagatcggtgtcggtgataccgacctgctgaaagcccagttcagtgccccactgtttaatgttttgcgctaactgattgagatcgaggggctgtgacatgacggaccatacattgaagaaaaaccccgcaagtataccacactccatctggcctgcggatgaactcaaacgcgcggaacaggaggcggccgacagcctcggcatcacgctgtatgaactgatgcagcgcgctggtcaggcggcctttactgtcgcgcgggaacattaccccggggcgcagcactggctgatcctctgcggccacggtaacaacggcggcgatggctatgtggtggcgcgtctggccgccgctgcgggcattgaggtgacgctgctggcgcaggagagcgataaacccttgccggaggaggctcatgccgcgcgtgaggcctggcttgatgccgggggcgccattcatgcgccgacgctggcctggccggaaggtgtggaactgattatcgatggcctgctgggtaccgggctgaccgacgccccgcgggagcacatcgccgcgcttatcgaacatgcgaatcaacatcccgcgccggtgctggcgctggatatcccgtctggcctgctggcacaaacgggcgcgacgcctggcgcggtgatcaatgccgcgcataccctgacttttatcgcgcttaagcctggcctgctgaccggtaaggcgcgcgatgtggtagggcagctgcatcatcatgcgctgggactggaaagctggctggcgggtcaggaaactcatataacccgttttgatgccacacagctggcagactggttaccccccaggcggccgacctcgcataaaggcgataacggacggctggttatcgtcggcggcgatcacggtacggcgggggctatccgtatgaccggggaagccgcgctgcgtactggcgcagggctggttcgcgtactgacgcgcagcgaaaatatcggccctatcatcaccgcccgcccggaactgatggtgcatgaactcacggcgcaaagcctggatgaaagcctcgaatgggcggacgtggtggtcgtggggccgggtctcgggcaacaggcgtggggcaaagacgccctgcgtaaaattgagaattttcgcaaacccatgctgtgggacgctgacgcactgaaccttctggcaatcaatcccgataaacgtcacaatcgcatcctgacgccgcaccccggcgaagctgcacggctactgaactgtagcgttgcagaaattgaaagtgatcgcttactttcagcccgacgtctggtaaaacgttatgggggtgttgtggtgctgaaaggcgcgggcacggttatcgcctgcgagaacggcgagacgggcatcattgatgccggaaatgccgggatgggcagcggcggcatgggcgatgtgctctctggtattattggcgcgctcgcagggcaaaaattctccctgtacgatgccgcctgtgcaggctgcgtagcacatggcgccgctgccgacaggctcgcggcgcgttatggcacgcgcggcatgttagcgaccgatcttttttccacgcttcggcgtgtagttaacccggatgtgattgacgtaaaccatgattaatcgagtgatccctttacctgacgaagaagcaaccttagatcttggccagcgcgtggcgcaggcctgcgatggcgcgacggtcatctatctgtatggcgatctgggggcgggtaagaccacgttcagccggggctttttgcaggcgctcgggcataacggcaacgtgaaaagcccgacctatacgctggtcgagccttataccctcgacaaactgatggtctatcactttgacctgtaccggctcgccgatccggaagaactggaatttatgggtatccgcgactactttggccgcgacgcaatctgccttgtcgaatggccgcaacaaggcgcgggcgtgctgcctgaaccggatatcgaaatccatatgtcataccaggcacaagggcgtgaggcgtgcatttctgccgtttcctcatcgggtaattcgttactggcgcgactggccggttaactgtaggaatggcgggatgatcaatcgcgttaaaagctggttcgcgacaatactgctgctggcctgtacccaggcaggagcagcaaccttatccgatattcaggtgtccaatggcaatgatcaggcgcgcatcaccctgagctttatgggcgatccggaatacgccttttcccaggacagcaaacgcagcgtggcgctggacatcaaacagaccggcgtgatccaggggttgccgctgcaatttagcggtaataacctggtgaaggctatccgctctggtacgccgaaagataatcagtccctgcgcctggtggtcgacctgacgcagaacggtaaaacccgtgcggtgaagcagcaaaacggcgccagctataccgtggtctttaccattaatgccgatgcaccaccgccccctccgcctccgccgccggttgtggtgaagcgcgtcgagacgccagccgttgcgcccgctattgcgccgcgtccggcagagcctgcccgcaatccttttaaaaatgaaaacgaccgcgtaacgagcgtgaccagcagtaatacggtgacccgcccggccatgcgctcgcgcagcgcgtccggtgacaaagtgatcatcgccattgatgccggacacggcggccaggatccgggcgctatcggccccggcgggacgcgtgagaaaaacgtcaccatggcgattgcccgcaaactgcgcgcgttgcttaatgacgatccgatgtttaaaggcgtgctcacccgcgacggcgattactttatttcggtgatgggccgctccgacgtggcgcgtaaacagaacgcgaacttcctggtgtcgatccatgcggatgccgcgccgaaccgtgacgccaccggcgcgtccgtatgggtgctgtctaaccgtcgcgccaacagcgaaatggccagctggctggagcagcatgagaagcagtccgaactgctgggcggggcaggggatgtgctggcgaacagccagtccgatccctacctgagccaggcggtgctggatttgcagttcggtcattcccagcgtgtcgggtatgatgtcgccgtgaatatgctcggccagctacagcgcattggttcgctgcataaacgccgcccggaacatgccagcctcggcgtgctgcgctcgccggatattccatcggtgctggtggaaacgggctttatcagtaacaacagcgaagagcgcctgctgggcagcgatgactatcagcagcagctggcggaagccatttataacggtttgcgccagtacttccaggcgcatccgatccagtcggccccgcagggcggtgccggccagacggcgagtgccgcttcctcgggcggcgcgttctttaactaaggagatttcatgccgattcaggttttgccgccacagcttgcgaaccagatcgccgcaggcgaagtggtggaacgtcctgcgtcggttgtgaaagagctggtggaaaacagccttgatgccggggcgacccgcattgacattgatatcgaacgcggtggcgcgaagcttatccgcatccgcgataacggctgcggcatcaaaaaggatgagctggcgctggcgctggcgcgtcatgccaccagtaaaatcgcctccctcgacgatctggaagccattatcagccttggctttcgcggcgaggcgctggccagcatcagctcggtatcccgcctgacgctgacctcgcgcacagcagatcagcccgaagcctggcaggcttacgccgaagggcgcgacatggacgtaacggtcaaacccgccgcgcatccggtggggacgacgctggaagtgctggatctcttttataacacccccgcccgccgcaaatttatgcgtaccgagaagaccgaattcggacatatcgatgaggtgatccgccgtatcgcgctggcgcgttttgacgtcaccatcaacctgaaccacaacgggaagatggtgcgacagtatcgtgccgtcccaccaggcggacagaaagaacgccgtctcggcgcgatctgcggcgtgccttttatcgaacaggcgctgcaaatcgaatggcagcacggcgatctggggatgcgcggctgggtggcggatccgcagtccaccacctccgccttcgccgagatccagtactgctacgtcaatggtcgtatgatgcgcgatcgcctgatcaatcatgcgatccgccaggcctgtgaggataaactcggcgccgatcagcaaccggcgtttgtgctctatctcgagatcgatccgcatcaggtggacgtcaacgtccatccggccaagcatgaagtgcgtttccaccagtcgcggctggtacatgattttatctatcagggcgtattgagcgtcctgcaacaacggctggatacggcgctaccgctggccgacgcgccggaaccgcgcagtatgccggaaaaccgcatcgcggcgggtaaaaaccagttcgccagcccggcggtcgcccgcgagcctgcgccggagcgttataccgcaccggcggccgcgccgcgcgctggacagggtggcgggcaaagcagcggtggcgcaggctggccgaacgcccagccgggctatcagaaacagcagggggcgttatatcgccagttgctggagacgcccgccgttgagcgtagcgcgccagcccccgaacccacaccctccgccgttgacgcgcacagccagagctttggccgcgtgctgacgattatcggccaggattgcgccctgctggagcgcgacggggcgttattcctgctggcgttgccggtggcggagcgctggtacaaacaggcacagctgacgccgggtaatacagcggcctgcgcacagccgctcttgatcccggttcgcctgaaagtcagcgctgacgagcgcgcggcgctgcaacgtgcacaggcaatgctggccgacatgggcatcgaatttatgtccgatgcccatcatgtgaccattcgcgccgtgcctttacccttacgccaacaaaatttacaaatcttgattcctgaactgataggctacctggcgcagcaaacaacgttagacgcggcgaacaccgcccagtggattgcccgtaagcttgagagcgtccacccgcagtggagtgtggctcaggccatcacggtgatcgccgatgtcgaacgtctttgcccgcagctggtgaaaaccccgccgggtggcctggttcaacctgttgatttacattcggcgatgaacgccctgagacatgactgaccagagtatggcgagcctgcctaaggcaatttttttaatggggccaacagcctccggcaaaacggcgttagccattgagttgcgtaaagttttgccagtagagttgataagcgtcgattctgcccttatttatcagggaatggatatcggcaccgcaaagccggatgccgacgaattacgcgcggcgccgcaccggttgctggatattctcgacccggcgcaggcctattctgcggctgattttcgccgcgatgccctggcgcatatggcagagatcaccgccgccgggcgtattccgttactggtgggcggcaccatgctctattttaaggcgctgctggaagggttatctcccttgccgtcagcggatccggcggtaagagctaaaattgaacaacaggcggccgagctgggatgggacgcactgcacaggcaactgctggagatagatccggtggccggtgcgcgaattcatccaaatgatccgcaaaggctttcccgggcactggaagtttttttcatttcgggtaaaactttaacggaactgacgcaaacgtcaggagaggctctgccgtatcaggtgcatcagttcgccatcgccccggcgagccgtgaactgctccatcagcgaattgagcagcgttttcatcagatgttggcttcaggttttgaagcagaagtgcgggcgctttttgcccgtggagatttgcatacggacatgccttccattcgttgtgtgggataccgccagatgtggtcttaccttgaaggcgagatttcatatgatgaaatggtttatcgaggagtttgcgccacgaggcagttagcgaagcgtcagatcacctggctgcgtagctgggacggggttcactggttagacagcgaatcgcccgaacaggcaagagatgcggtattacaggtagttggtgctaacgcaaactgaatgtgtacaattacatcgtatcgtgcgcaaaattttacgcagttttcagggcctccgggttctaagtacaaaacaagcatataaggaaaagatagaatggctaaggggcaatcattacaagacccgtttttgaacgcactgcgtcgtgaacgtgttccggtttctatttatttggtgaatggtatcaagctgcaaggtcaaattgagtctttcgatcagttcgtgatcctgttgaaaaacacggtcagccagatggtctataagcacgcaatttctactgttgtcccgtctcgtccggtttctcatcacagcaacaacacgaccggcggctccagtaactatcatcatggcagtaacgcgcaggggtcctctgcgacgcaacaagacagcgacgacgccgagtaaggttagttgttgttaatccatgccggggagccagattatctgagttccccgctggtattttaagagggtttacgcttgtttgaccgttatgacgccggtgagcaggcggttctggtacacatctatttttcgcaagacaaagatatggaagatctccaggagtttgaatccctggtctcttcagctggtgtcgaagcaatgcaggtggttaccggtagccgtaaagcaccgcacccaaagtattttgttggtgaaggtaaggcagttgaaatagcggaagccgttaaggcaacaggggcatcggtcgtactttttgatcatgcgctgacccctgctcaggaacgtaatcttgaacggttatgcgaatgtcgtgttattgaccgcaccggcttgattttagacatttttgcccaacgtgcacgtacccatgaaggtaagttgcaggttgagctggcgcagctgcgccatatggctacgcgtctggtgcgtggctggacccaccttgagcgacagaaaggcgggattggtttgcgtggtccgggggaaacccagctcgagaccgaccgtcgtttactgcgcaatcgtattatgcagatcctctcgcggcttgaaaaagttgaaaagcagcgtgagcagggacgtcgctcccgtcagaaagccgatattccgaccgtatccttagtgggatacaccaacgccggcaaatcgacgctgtttaaccagatcaccgaggcccaggtttacgccgcagaccagctgtttgcgaccctggatccgacgctgcgccgtatcgacgtggcggacgtgggcgaaaccgtgcttgcggataccgtagggtttatccgccatttgccacatgacctggtggccgcgtttaaagccacgttgcaggaaacccgtcaggccacgctgctgttgcacgttgtcgacgcagcggatgtccgcttgcaggaaaatatcgccgcggtggatacggtgctcgaagaaatcgacgcgcacgaaatccccacgctgatggtcatgaataaaatcgatatgctcgacagcttcgagccgcgtatcgatcgtgacgatgaaaataaaccgattcgggtctggctttcagcccagaccggcgtcggtgtaccactgttattccaggcgttaaccgaacggctttccggagaagtcgcgcagcacacgttgcgtctgcctcccgaagaagggcgtttgcgaagccggtttcaccagcttcaggcgatagaaaaagagtggatggaggaagacggcagcgtgggtatgcagatacgcatgccgattattgactggcgtcgactctgtaaacaagaaccggcattggtggactacgtggtctaaccggcgtatcacctgaagacatttcccctctggggatatcaccgcataacaaatatggagcacaaacatggcgtggaatcagcccggtaataacggacaagaccgcgacccgtgggggagcagcaataagcccgacggtaactctgggggaaataaaggcggtcgcgaacaggggccgcctgatttagatgatattttccgtaagctgagcaaaaagcttggcggtctgggcggcggtaaaggtaccggttcaggcggcggaagttccgcgccaggccctcgcagtcatatgggaggacgtgtggtcggtatcgtcgctgcggccgccgtcattatctgggctgccagcggtttctataccattaaagaagccgagcgcggtgtggtcacccgtttcggtaaattcagccatctggtggagccgggtcttaactggaagccgacgtttattgataacgtgacggcggtaaacgtggaatccgtgcgtgaactggcggcttccggcgtgatgctgacgtccgacgaaaacgtagtgcgcgtggaaatgaacgtgcagtaccgcgtgaccgatccgcagcactatctgtttagcgtgaccagcgcagacgacagcctgcgtcaggccaccgacagcgccctgcgtggcgtgatcggcaaatacaccatggaccgtatcctcaccgaaggccgtaccgttattcgtagcgatacccaacgtgaactggaagagaccattcgtccgtacaacatgggtatcaccctgctggacgtcaacttccaggccgcgcgtccgccggaagccgtacaggccgcctttgatgatgcgattgccgcgcgtgaaaacgaacagcaatctatccgtgaagcggaagcttacgcgaacgaagtacagcctcgtgccaacggtcaggcccagcgtattcttgaagaagcccgcgcataccgcacgcagaccatcctggaagcccagggtgaagtggcgcgttttgccaaacttctgccggaatataaagccgcaccggaaattacccgtgaacgtctgtatatcgaaagcatggaaaaagtgctgagccacacccgcaaagtgctggttaacgataaaggcggcaacctgatggtgcttccactggaccaaatgctgaagggcggtaacgccagcggagcaaaaaatgagaccagcggtgccaacaatctgttgcgcctgccgcctgcctcaaactccggcagcaatgccagcaccgcaccgactgccagccagggtgacattatggaccaacgccgtgccaacgcgcagcgtaacgactcacagcgtcagggggaataacgatgcgtaagtctattattgcggtaattattatcgtgctggtcgtgctctatacgtctattttcgtggtgaaagaaggcgagcgcggcattaccatgcgtttcggtaaagtcctccgtgacgatgaaaacaaaccgctggtctttgagccgggtctgcatttcaaactgccgtttatcgaagccgtgaaaatgctcgacgcccgtatccagacgatggataaccaggctgaccgctttgtgactaaagagaagaaagacctgattgtcgactcttacatcaagtggcgcatcagcgacttcagccgttactacctggcaaccggtggtggcgatgtctctcaggcggaagtgctgctgaaacgtaagttctctgaccgtctgcgttctgaaatcggccgtcttgatgtgaaagacatcgtgactgactcccgcggtcgtctgacgctggaagtgcgcgatgccctgaactccggttctgccggcaccgaggatgaagtggccacgcctgctgccgatgacgaaatcgcgaaagccgcgaaacgcgttacggcggaaaccaacggtaaagtgccggtggtgaacccgaacagtatggcggccttaggtattgaagtggtcgacgtgcgtatcaagcagatcaacctgccgaacgaagtgtcggaagcgatttacaaccgtatgcgcgctgagcgtgaagcggttgcccgtcgccaccgttcacagggccaggaagaagccgagaagctgcgcgcggcctccgattacgaagtgactaaaacgctggcggaagcggagcgtgaaggtcgtatcctgcgtggtgaaggtgatgccgaagcggctaaactctttgccgacgcctttagccaggatcctgacttctacgccttcatccgtagcctgcgtgcttacgagaacagcttccagagcaaccaggacgttatggtgctcagcccggacagcgatttcttccgctacatgaagacgccgggcaacgccgtacgctaaccccggtcaggctgtttaatctgctaaaaaccaccgtgttcctcaggagccggtggttttctcattcagggacatttataaatgaacaccaccatctggctggcgctggccctcgttctggtgctggaaggcctcgggccgatgctttatcctcgtgcatggcgacgtatgatcggcgcgctcattcagcttcctgataacattttacggcgttttggcggcggtctagtggttgctggcgtcgttgtctactacatgttgaggaaaacgattggctgaagacaaagcacgccggtttgccgaaattaggcgacaaaaagtgctgattatcagaaaaagcgatggtagaatccttttttaagcaaacggtgattttgaaaaatgggtaacaacgtcgtcgtactgggcacccaatggggtgacgaaggtaaagggaagatcgtcgatctcctgactgaacgggctaaatttgttgtacgctaccagggcggtcacaacgcaggccatactctcgtaatcaacggtgaaaaaaccgttctccatcttattccatcaggtattctccgcgataacgtcaccagcatcattggtaacggcgtggtgctgtctcctgctgcgttaatgaaagagatgaaagaactggaagaccgcggtatcccggttcgcgagcgtctgctgctgtctgaagcctgcccgctgatcctcgattatcatgtggcgctggacgtagcgcgtgaaaaagcgcgcggcgcgaaagcgatcggcaccaccggtcgtggcatcggtccggcctatgaagataaagtagcccgtcgcggtctgcgcgttggcgacctgttcgacaaagacaccttcgctaccaaactcaaagaagtgctggaataccataacttccagctggttaacttctacaaagttgacgctgttgactaccagaaagtgctggacgatgtgatggcggttgccgacatcctcacttccatggtggtggacgtctccgatctgctcgaccaggcgcgtaaacgtggtgatttcatcatgttcgaaggcgcgcagggtacgctgctggatatcgaccacggtacctatccgtacgttacctcctccaacaccaccgccggtggcgtggcgacaggttccggtattggtccgcgctatgtggattacgtgcttggcatcatcaaagcttactccacccgcgttggcgcaggtccgttcccgacggagctgtttgacgacatcggcgagttcctgtgcaaacagggtaacgagttcggcgctaccaccggccgtcgccgtcgtaccggctggctggatgcggttgccgtgcgccgtgcggtgcagatcaactccctgtctggcttctgcctgaccaagctggacgtgttggatggcctgaaagaagtgaaaatctgtgtggcataccgtatgccggatggccgcgaagtgaccaccacgccgatggctgccgacgactgggaaggcatcgagccgatctacgaaaccatgccgggctggtcagaaaccaccttcggcgtgaaagagcgtagcggcctgccgcaggctgcgctgaactacattcagcgtatcgaagaattaacgggcgtaccgatcgatattatctctaccggtcctgaccgttctgaaaccatgatcctgcgcgatccgttcgacgcataatcacgccaggggcgccatcacagcgccccttgttttgcccttattacttcttcccatcaccgttcatttctaaataaattagcagcctgacaggtggctggtttatcatcaatagtgtcaatacaccacgggtgtcccgcgttttttcttatttcctgaggttgatgtgcagttaacgagtttcaccgattacggattgcgagccttaatctatatggcgtcgctgccggaaggacgaatgaccagtatttctgaagtgacagaagtgtacggtgtgtcccgtaatcacatggtcaaaatcatcaaccagctgagccgggcaggctacgtcacggccgtcaggggcaaaaacggcgggatccggctgggtaagccagcccgtgctatatgtataggtgatgtagtgcgtgaactggagccgctgacgctggtcaattgcagcagcgcattttgtcatatcacgcccgcctgccgcctgaaaaaggccctttcccaggccgtgcagagctttcttaaggagctggacagctacacgctggcagacctggttgaagagaatcaaccgctttataaattattgctggtggaatgacagacttttccgccagagctgacaacggaggaaccgcaatgtcacaagatcctttccaggaccgcgaagctgaaaagtacgccaaccctattcccagtcgtgaattcattctcgatcacttatccaaacgcgaaaaacccgctaaccgcgaagaactggcggttgaactcaatatcgaaggcgaagaacagcttgaagggctgcgtcgtcgcctgcgcgccatggagcgcgacgggcaactggtcttcacccgccgccagtgctatgcgctgccggagcgcctcgacctgctgaaaggcaaggtaatcggtcaccgcgacggcttcggcttcctgcgcgtggaaggccgtaaagacgatctctatctctcttctgaacagatgaaaatgtgcatgcacggcgatatcgtgctggcgcagccgctcggcgctgaccgtaaaggtcgccgcgaagcgcgtattgtgcgcgtgctggagccgcgtaccgggcagatcgtcggccgctacttcaccgatgccggtgtgggctttgtggtgccggatgacagccgcctgagcttcgacatccttgtgccgccggaagaagtcatgggcgcgcgcatgggcttcgtggtggtggttgaactcacccagcgtccgacccgccgcaccaaagccattggtaaaattgttgaagtgctgggcgataacatgggcaccagcatggctgtcgacatggcgctgcgcacccacgaaatcccttacgtctggccgaaagcggtggaagacgagatcgccagcctcagcgaacaggtgccggaagcggcgaaatcaggccgcgttgacctgcgtaacctgccgctggtcaccatcgacggcgaagacgcccgtgacttcgacgatgcggtttactgcgagaaaaaacgcggtggcggctggcgtctttgggtggccattgccgacgtcagctactacgtgcgccctggcaccgcgctggacgacgaagcgcacaaccgcggcacctcggtctacttcccgtcgcaggtggtgcctatgctgccggaagtgctctccaacggcctgtgctcgctcaacccgcaggttgaccgcctctgtatggtctgcgagatgaccatctccaccaaagggcgcttaaccggctacaaattctatgaagcggtgatgagctcccacgcgcgtctgacctacaccaaggtctggcatatgctggaaggcgatcaggagctgcgtcagcagtacgctccgctggtcaaacacatcgaagagctgcacaacctctacaaaaccctgaaccaggcgcgcgaagagcgtggcggcatctctttcgagagcgaagaagccaagttcatcttcaacgcggaacgccgtattgagcgcatcgagctgactgagcgtaacgacgcccacaagctgatcgaagagtgcatgatcctcgccaacatctcggcggcgcgttttgtcgagaaagcgaaagaaccggcgctgttccgtattcacgatcgtccgactaacgaagccatcacctccttccgctcggtactggctgagctgggcctggagctgccgggcggcagtaagccggagccgggcgattacgcggcgctgctggaatccatcgccgatcgtcccgatcatgaaatgctgcaaaccatgctgctgcgctccatgaaacaggcgatttacgatccggaaaaccgcggtcactttggtctggcgctgcaacagtatgcgcactttacctcgccgatccgtcgttatcctgacctctcgctgcaccgcgccatcaaatacctgctggcgaaagagcaggggcacgaaggcgacagcaccgaaaccggcggctggcactacagcgtggaagcgatgctgcaactcggtcagcactgttctatggccgaacgtcgcgccgatgaagccacgcgtgacgtcgccgactggctgaagtgcgactttatgcaggatcaggtgggcaacaccttctccggggtgattgccagcgtcaccggctttggtttcttcgtgcgtctgaacgagctgttcatcgacggtctggtgcacgtgtcgtccctcgacaacgactactaccgtttcgaccaggttggtcagcgtctgatcggcgaatccggcggccagacctatcgcctgggcgaccgcgtggaagtacgtgtggaagcggtcagcatggacgagcgtaaaatcgacttcacgctgatttccagcgaacgcgcgccgcgtaacgtcggcaaaaccgaacgcgaaaaagccaaaaaaggcgcgccgggacgtaacgtcagccgtcgtcgtcaggtgggcaaaaaagtgaacttcgagccggatagcgcattccgtggcgaaaaaggcaaatcaaaagccaaagccaaaaacccggacagcgcgcagccgaaagcgaagaaagagaaaaagccaaaggcgccttctgcgaaaacgcaaaaaatcgcagcggcgaccaaagccaagcgcgcagcgaaaaagaaagtcgctgaataacgcagcctctgcacaataaataaaagcctcttataataaggggcttttttttattttcgcggttagttaattttcagcaatagatatttattatttgtcattaggctcaaagcccggcggtgtagagtagctcaataattattattttgctgatgagcaaattctcaaggagctactatgcatctggcccgttttccgcgcctctcgttaggtcatttccccacgccgctcgaacctttagataatctgagtaaattactgggcggaccgaaaatatggatcaagcgcgatgacgccaccggacttgccaccgggggaaataaaacccgcaaactggaatttttgctcgccgacgcgctgcaaaaaaacgccgatgtgattattacccagggcgcaacccagtcgaatcacgtgcgtcagactattgccggcgcggcaaaattaggcttacaggcgaaagtgctgctcgaaaagcgcgtcaccgatttcggcgaagattaccagcgatccggtaacgttttgcttgatgaactgctcggcggcgagatagtcgcccatctgccgggcggcaccgacatgcagcaggcgatggacgactatgccgccacgctgcgcgaacagggctttaacccttatgtcatccccggcggcggctctaaccccataggcgcgctgggctacgtggcctgtgccgaagagctgctttaccagtcctcccaattacgcttacgcatcgatcacgtggtgcacgccaccggcagcaccggcacccaggcgggccttgtcgccgggtttactgcgaccaatagccatgtgcccgtgctcggcatcagcgtgcgcgcgccgaaagagaagcaggaagagaacgtatggaacctggcctcccgcacccttgcgctgctgggtgtggcgggcgagctgccgcgtaaccgggtggttgccaacagcgattacgtgggcgacggctacggtttacctactgacggcatgacagaagcgctgcgcctgctggcacgtcacgaaggcattctgctggatccggtctattccgggaaaggctttgccgggctggtggatctgatccgcaacggtcatttccgtcaggacgaaaacgtggtctttatccacaccggcggttcggcgggtctgtttggttatcgtcaggtgctggaaaaatgacacccttcctgctcggcgtgctgggcggcatggggccgctggcgacggtggattttatggcaaagctgctggaggccacgcctgcgcagcgcgatcagcagcagatcccggtgctggcgtggaacgtgccgcagatcgccgaccggcaacaggcgctggcgggcacaggcccgtcgcccttgccacagttgctcaacggtatcaaaacgttaaacgccgcaggggcgagccacatcgccatcccctgtaacaccgcccatcactggtttgcggcgttgcaggcggcaagcgccgcgccgctggtgcatatcgttgaggccaccctcacgcagatccgccctgagcacgccacgcgcgttggggtgatcgccaccaaaggcacgctcgacgcaggctggtatcagcaggggctgcgccgtctgggcatcacgccggtgctgcccgacactcatgagctggaaaagctgtttgtaccgggctgctacgcggttaaacgcggtgcgctgcgtgaaggcggcgagttactggcgcgccaggcgcaggcgctggttgaacgcggggcgcagcaattaatcctcgcctgcaccgaagtgccggtcgccctgaaggccattgactccccctttctttcccacgccgtcgatccggcgcaggcgctggcggagcgctgttccgccctctggcaggattatcgccattcctgttgtgaataaatgcttagcaataatccgtataaataaatcaacgccggctgaatatactggtcgggcgctaaataattaatttcctcacaggataataaaatgaaaaaaagtctctgcttattactggcagcgggtagcttatggtcgcagatttcttttgccgccacgccggaagaagtccgtattgcttatagcggcggttcgcaggtattaatgctggcaaaagccgatggttcgcttgataaagcgttaaacagcaaagtgaaatgggtgcaatttgcttccggagccgatgcattaacctatttcgccagtaatgctattgatattgccaattttggctccagcccggcgacggcgggtattgtgcgtaaattaccggtggaaataatcggcgtgtccggcgtgatcgccagctacgaacgcttaatcggcaaagagggcatcacccgcattaatgatattgaaggcaaacgtgtgggctatccgccaaactccaccgcgcaatatgcgctggaggcggcgatcagcgtcaacaaactcgaccgcagtaaaattaccctgttgccattgcgtccggcggaaatggttgccgcatggaagcggggcgatattgacgcgggctacgtctgggcgcccttcgcccaggagctggagtcagctggcgggcaccaggtgttcgccaccaaagatctgcaacaggcgggctacctgatctacaacaactatgtggtgcgtaaagcctttgccgaacagtacccggaggtggtcagcgccttcctgcgcgtgcatcaggaaaaggtcaatgagttcaaaaaagatcctgaacgtgccgccgccatcgtggcgaaagaagtgggcgcgcctgtgaccaccgccgccaatacgctgggcggtctggaatacccgacgctgagcgaacagggcaccgccgcctggctgggcgacggtacgcacagcaccgacagcggcatcggcaaagcgctgaccaaaacctcaaacttcctcgccggaattggcgagatccgcaagcgtgacatccccgcgaactgggacgcggccatcaactcccgttaccttcgcgatgcggcggtgaacgcaaaatgagagtaagtcagcacatcgccatcagcgtgctgtcggtggcgatcttttttatcctctggcaggtggcggcgacccggcaatgggtggatccgctgctgctgccgtcgctgacggacatcggtctgaccacggaagagctgctcgctgacggttaccggcaggttccgctctggcagcatatcgtcgtcagtctcgcgcgggcgctcagcgcctttgcggtggcgattgtgatcggtattccgctcggcctgttgatgggcctgtccgacgggctggcggcagtgcttaaccccttcgtgcagtttctgcgtccgctgccgaaaatcgcgctgatcccgctggcggtggtatggctcggcatcggtgaaagctcgaaattctttctgattttcatcgccaccttcctcagcgtggtggtgggggccagcgcggcggtggagcgcattggtcgctcgcgcattcgcgtggcgcagaccctcggcgcttcccgacaacaaattttcctgcgcgtggtgttgccggacgcgctgccggatctgtttaccaccgtcaggctgtcgattggcattggctggacgtcgctgatcgccgccgaaatggtcgccgccagctctggtctgggctggatggtgatcaacgccagctcttacttacgcaccgatatcgtcatgctgggcatcctgctgctcggcggcattggctatctccttgatttacttatcctcggcctgcaacgcgtgtttgtgccctgggcaggaaaagaataatgactatacagattgcgctggagcaggtgtccctgcaatttgcggcgaaaccgcatccctttaccgtgctggaagacgtctccctgtcgcttgcgaagggcgaatttgtggtgctgttggggccgtcgggctgcggcaaatccaccattcttaatcttgtggccggctttacccggcctgaccgcgggcgggttctgagcggcggcgagccggtacgcaagcccgggccttcccgcgggatgattttccagcagccgaatctgttcccctggctgtcggtgctggataacgtcacctttggcccgcgcctcggcagccaccgcaaagacgacgtgaacgcgaaggcgctggactggctggcccgcgtcgggctgaaaggctttgaacatcacgccccctggcagttgtcgggcggcatgaaacagcgcgtggcgctggcgcgcgcctggctgccggaaccggaagtgctgctgcttgacgagccgtttggcgcgcttgacgcccagacgcgcctgatgatgcaggaattgctgcgcaacgcctggctggaaacggacaccacgctgctgtttgtcacccacgacgtggaagaagcgctgttcctcgccgatcgcatcctgatcatgtcggcaaaacccggcaagatcgtggaagaaattgtcagtcccttcggtcgcgagcgcgacattgaatccctggtggaacacccgcgctacggcgaaatcaagcatcacgttctgcatcgcgtccgtcaggaggcaaagcgtcatctgagttaaccccttcatcaaccgacatcacaaaaaggtggaagcaatgagcattagcgagttaaccgcacgactggaacagagccttaatcaacaccgcgacgagtacatcgccatctcaaaagatattcatgcgcacccggaaaccggtaacaatgaatattacgccagcggcctgctgacggcgctgctggcgaaaaatggctttaccgtcacggccaacgtcgccggtcacgaaaccgccttctatgcggtaaaagagagcggcaggccagggccgaccattgcttatctcgccgaatttgatgcgctgatcgatatcggccacgcctgtggacataacatcatcggcgtttccagcatcgccgccgccattgccctgagccagacgctggataaaaccggcggcaaagtcgtggtgctgggcacgcctgcggaagagggcgggctgcggggtaaaggtggaccgaatggcaacgtgaaagcccgctttgttgagcacggattcctgcgggatgtagacgcggcgatgatggtgcatccgggtggcagaacgcgtctgaccgggccgttccttgccaataaccatctctacttccacttttatggaaaaccctcccatgcgggcagctcgccgcacaaaggggtcaacgcgctggacgcgctggtgctgctctataacggcatcagcgtgctgcgccagcaactgccggacggcgtgcgcgtccatggcatcatcactaatggcggccaggcgccgaacgtgatccctgaatacgcctcggcgcatttttatatccgcgcggaaagccgtgaggccgttgaagcgctggagccacgcatccgggcgattgccgagggcgctgcgctggcgaccggcgcgacggtaaaaattgaacatcaggtcggcccgcgggatttcaacatcaatgacacgctgaataacctgtttcttgaagagttcacggcagtgggcgaaccggtcgatctcagcgccaaagagggcaaaggatcgacggacgtcggcgacatcagccatgcagtgcccactgcgcatccgtccatcaagattggcccggacgatttgatcggccacacggtcgccttccgcgaagccgccaactctgaaaaagggtacgaagccttaatcaccggggcgctggtgctggcgcgcgccgggctgcggctgctcaccgagcctgcgctgcttcaggcggcgaaggatgaatttgccggacgacctaccacctcaaacgcggcctgatcgccaccggagccagaaaaacaatgaaaatgacattctctgccgccgcactgctgctggcggcggctttaccctggggaagcgcactggccgaagccgtgaaccgtaatgcgacgctgaacatcgcctatggtaaccggcccggcactctcgatccgtatctcaccaccaataacgccacctctgatgtggatcgccatatctttgaagagctgttcaccatcaacgataagtttgagccggtgccggatctggtggcgtcctatacgctgagtgacgatcgcaaaacctacaccttcgtgctgcgcgacgacgtgaagttccacgatggtcagccgctcaccgccgatgacgtggtggcttccatgacgcgctggctggcggtatcgacgcagggtaaagctaacctgccgggggcgcagttcagcaaggtggacgacaaaaccgtgcgcctcacgctgccggagccttcgctaatcgcccttaacgtgctggcggacgtgaaaaacatcgccgccatcatgcccaaacgcctgatcgaccaggccaacagcagcaaaaaaccggtcaccgagcttatcggtaccgggccatacaaactcgcggagtttaaacagggcgagtatttacatctgacgcgctatgacggctttgtgtcgcgcaaagagccgtccagcggactttccggcgctaagccagccaacgtaaaagacatctggttccgctatatcaccgatgaatccacgcggctggccggagcgatgaccggcgaatacgacattgtgtttaacctgccgaaagacaatatcgatgcccttaccaacgcgccggatctgagcctggcgcggcccgaaagcggcggttcgctgatcacctatctgttcaacaaacagcaagggccgttcgctgacctaaagcttagacaggcgtttaacctcgcgctcgacgtgcaccagacgctgctggcgggctacagcgatccgcgtttctttaaagaagatccgtcgctgggattcccgaatcaggtggactggtacagcgaggcgggcaagccattctggaaccagcataaactcgaggaggctcgcaaactggttaaagaatccggttataagggcgaagaagtggtgattatcgccaccaaagagtatgcagagctgtataacctggcgattgtcgcccagcaggtgctgaaacagatcggcgtcaaatcccggctggacgtctacgactggccgacggtactgcaacgccgtcaggatccgaagaacttcgatctgtgtgcgctggagttctccatgcgtcaggtgctgcaccagtatcccttcctcgactcccgggcgaagtttccgggtctgagcaacagtcaggaaatcgatgcggcgcttgatggcatcaagcaggcggcatcgctgaaagaagcgcggccactggtggataaactgaacgtgctgacctggcagtatctgccggttatcgtgcttggtcataccacgcctgagccggtcgccctgaagaaaaacgtgcacggctaccatgatctgattgggccggtgctgtggaatgttaccgtcacgccgtaaccggagacgtctatgaagtggttcttgtttcaccggctgatggcgctgctgcccgtgctgctggtggtatcgctggtggtgttttgcctggtgcatcttgcgccgggcgatccggtgctggtgatcctcggcaatgacgccagcccgcaggacattgccgcgctgcgccagcagatggggctggatcagccgctgctgatgcaatttgtgcgctgggcgggggcggtgttgtccggcgatctgggccactcgctgtttctcaatgccagcgtcagcgagctgtttttacagcatctcaccccgacgctggcccttgcactgtacgcgcagctgattgcgctggtgctggggctggggagcggggcgatcagcgcctggcagcatggcggcatggccgaccggatcattcgcgcgctggctaccttcggcatgtcggtaccgggctttctgctcggcctgttcctgatcttctttttcgccgtgcagctgcgctggtttccggtggtgggctatcgctccaccaacgaaaacggtctgcaaaatctctggtatctgacgctgcccgccattgcgctcggttttcgtattgccgcgctgatctcacgcatgacccgcgcggtaatgctcgacgtgctgcaggagaattttattcataccgcccgcgccaaaggcgtgcccgagcgcatggtgctgctgcgccatacgctgaaaaacgccctgatcccggtgctgaccatctgcggggaatccttcgcctcgctggtcaccggcaccatcgtcatcgaaagcgtattcggcattcccggcgtcggctcgctggtggtggactccatcgagcggcgggatttcacggtgatccagggcgtggtgctgctgatcaccgtctgttacgtgctgattaatctggcggtggacgtgctcagctatatggtcgatccacgcctgtccgtcgaggggagtgaaagcgcatgacgcgaaacaaactctggctatggtgcggcgtgctggcgggcattgtgctgctctcggtgtgcggcacctttttcagcccttacgatccttatgctatcgatccgctcagccgcctgaaggcccccggcgcggcgcactggtttggcaccgataactttggccgcgatctgtttgtgcgcgtggcgctggcggtgcgggtatcgttttccgtcggggcggcggtggcggtaatagccggggcgatcggcatgctgaccgggctgctctgcgcctggtatcgcccggtggatcgcattctgatgcgcgtctgcgacgggctgttcgcctttccgtcgttgctgctggctatcgctattgtcggcgtgctggggccgaacatcgctaacgttgtgctggcgctgtcgctggtatacgtgccgtccattgcgcgggtgatccgcggcgcagcgctggttatcaaagagaaaaatttcattgaagccctgcgcgcgcagggagcctccccggcgcgcattatctggctacatctgctgccgaacgtgctgtcgccgctgattgtgcaggtcacctgggtgttctcagtggctattctgaccgaggccgcgctgagctttttaggatccggcgtgcctgcgcccacgcccagcctcggcaatctgctgctggagggaaaagcagtgatctttaccgcctggtggatgaccttttttcccggcatcgccattgtgctgctgatcctcgcgctgaatattatcggcgacgacctgcgcgacagcgccgagccggggctgaaaccgctgccgcagcgtgtcctgcgcctgctgaaaaaaggggagcaacatggttaatccgccgccgctgttaagcgtcaaagatttgcgggtgaatttcgccacgccgcagggcgtggtggccccggtgcgcggcgtctcctttaccgttcatcatcatgaaacgctgggcatcatcggtgaatccggttgcgggaaaagcgtcaccgcgcaggcgctgatggggctattgtccccgcgcaccagccgcactgaaggtgaaatcgccctcggcggtcaacgcctcgacacgctcccggcaacggcacgtcgtcggcgctgcggcggcgagatggcgatgattttccaggatccgctctccagcctgaacccggtgctgactatcggctttcagattgaagaaagcctgaagctgcataccgcgttaaaccgggcgcagcgccagcaaaaacggctgcgcctgctggagcaggtgggcattgctgatgccgcccgctgcgtcaacgcctggccccatgagctttccggcggcatgcgccagcgggtgatgatcgccatggcgatcgccagtgctccgtcgctgctgattgccgatgagccgaccaccgcgctggacgccactatccaggcgcaaatcctgcaactgctggacgacatcaaacagcagagcggaatggggatcatctttattacccacgacctgagcgtggtggcgcggctgtgtcagcgcgtggtggtgctctacgccgggcaggtggtggaggaaacggacgtgatgacgctgttcgaaaatccccgccatccctatacccgcgcgctgctggcggcgcggccctcgctgtcccacacgccgaagacgcggctggaggagatccgcggcagcgtcccggcgctggatgcgctgccgggcggctgtacctttgccgatcgctgtccgctggcgaccgccacctgtcgcgcacagccgccgcagctgcgcccgctcggcggtcacggtcatcaggtgcgctgctggcgcgcagaagaaacgggagtcatgccatgaataagccgttgctgaacgtacagcatctgtccaaaacctttacccgccgcgggcacagcgtgcaggcggtgcaggacgtcagttttaacatccatgccggggaaacctacgcgctggtcggcgaatccggcagcggtaaaagcaccatcgggcgcactcttctcggtttaaccccggcctccggcgggcgggtggatttcaacggccagtcgctgctggatctcagcgccgccggatggcgcagcgtgcgcaaagacattcagatgatcttccaggatccgctctccacgctcgatccaaagcgcaccattggctacagcattgaggaaccattgatcattcacggcgaacgcgatgcgcagcgtcgtaaaaaagcggtggcggcgatgctggaacaggtcggtctgcgggcgcaggatgccggacgttatccgcaggcgttttcaggcggacagcgccagcgtatcggcatcgcgcgggcgctgatcctgcgtccgaagctgatcatctgcgatgaaccggtgtcggcgctggacgtttccattcagtcacaggtgctgaatctgctgatggatttgcagcgcgactatggcctcgcctacctgtttatctctcacgatctcaatgtggtgcgtcacgtggcggatcgggttggcgtgatgtatcgcggacaactggtggaagaggcgaccagcgcgcagctttttgcccatccgcagcatgactacacgcgctggctgctgtcggcgatactgcctgcgcatcccgcagaaaaaaaccggcttcctgcggcggtgaatgcgtaacggggaaggacgtccgggggcgtcgtgggttataatgggcgggaaacacccttttaacctctactgagtacccttcatgagtgaaatgatttatggcatccacgcggtgcaggcactgctggaacgcgcccctgagcgctttcaggaagtttttattctgaaaggacgcgaagataagcgcctgatgccgctgatccatgcgctggaagcgcagggcgttccggttcaggtggcctcccgtcagtttctggacgagaaaagcgaaggcgcggtacaccaggggatcattgcgcgcgtgaagccgggtcgtcagtatcaggaaaacgatctgccggatctgatcgcaagcctggataagccattcttcctgatccttgatggcgtcaccgatccgcacaacctcggggcctgcctgcgcagcgccgatgcggcgggcgtccatgcggtgatcgtgccgaaagaccgctctgcgcagctgaacgcgacggcgaaaaaagtcgcctgtggcgcagcagaaaacgtgccgctgatccgcgtcaccaacctggcgcgcaccatgcgcgtattgcaggaagagaatatctggatcgtcggcacggcgggcgaagcggaccacaccctgttccagagcaaaatgaccggcgcgatggcgctggtgatgggcgcggagggcgaaggtatgcgccgtctgacccgcgagcattgcgatgagctgatcagcatcccgatggcgggcagcgtctcctcgctgaacgtgtcggtggcgaccggcatctgcctgttcgaagcggtacgccagcgcggttaactgtctgcgaacaataaaaagggccatcagatgatggcccttttttctggctgtaaaacggcttacggccttctgaacagcgcgatactgcggccttccagttcgaattccttctctttggtaatgatcagcccgcgtttggcggtatcggacgtggtcagctccagcatccagccctcatccgtggactgcgggatcaggaagggcacgttaccttcgaacgggttaaacagcaccagcacttcgtgccacaggccttcttcatcatgcaaatcgtggcgggtcagtgaaacgcccagcgtcgagccttcatcccactgctccggctgctgatagccgccaccggcgttgaaccacttgatctccgtgccgtcgcgccagctttcacggcgcaacagcggctgcttcgcgcgcattttgatcagatgacgggtgaactcgcgcagcgcctcactgctttccggcaggttatcccagtgaacccaggaaatctcgctgtcctggcagtagccgttattgttacccatctgactgcggccaaactcatcccctgccagcagcattggcgaaccgtgggacaggaacagcgtggtgaggaagttacgcttctgccgttcacgcacgttgttgatgccttcgtcgtccgtcgggccttccgcgccatagttataggagcggttatcgttatggccgtcgttattgtcttcgccgttatcgtcgttgtgcttctcgttataggacaccagatcgttcagcgtgaagccgtcgtgggcggtgataaagttgacgctcgaccacggacggcggccgcgcagatcgtaaatatcgccggagcctaacagacgcgcggcaaagtcggtggagacattgacgcctttccagtattcacgcaccgtatcgcggtatttatcgttccattccgcccagcccggcgggaagccgcccacctgatagccgcccggtccgatatcccagggctcgccgatcagcttcagtttcgacagcaccggatcctgcataatggcatcaaagaagccgccgcgctggtcaaaaccttccggttcacgaccgagaatggtgcctaagtcgaagcgaaaaccgtcgatatgcatcgattctgcccagtaacgcagggaatccatgatcatctgcaatacgcgcggatgcgaggtgttgacggtgttgccggtgccggtatcgttgatgtaataacgatgctgatccggcatggtgcggtagtaagagaagttgtcgatgcccttaaaggagagcgtcgggccgagttcattaccctctgccgtatggttgtacaccacgtcgaggatcacttcgatgcccgcatcgtggtacgcgcgcaccatgtcgcggaaaccctgaatgccgttagggccgaaatagcgcgaagccggcgcgaagaaaccgagggtgttatagccccagaagttcttcagccccttatccagcagatgctgatcgtccgggaaccagtgcaccggcagcagttccaccgaggtcacgcccaggctcttgatgtactccaccgtcgccggatggcccatgccttcataggtaccgcgcagttcttccggaatggcggaattgagctgcgtaaagcccttcacatgggtttcatagagcaccgtttgcgaccacggaatgtttggacggttttcatctttccagtcgaattcattgggatcgatgacgcggcattttggcgtaaagggcgcgctgtcctgggtatcaaaggtcagatctttatcttcgtgcagcagctcgtaggcgaaatgcgcgtcattccactcgatgtcccccgccagctcacgggcatagggatcgagcagcagcttgttggggttaaaacgatggccgttttccggatcgtagggaccataaacgcgatagccgtagagcgcgccgggttgcagaccaggcacgtaaccgtgccagatttcatgggtatattccggcagatccaggcgggcgatctcggttttcccgtcctgatcaaacagacagagttcaacccgttctgcgtgtgcagagaaaagcgcaaagttgacaccctcgccatcaaaattggcgccaagacattcgctggttcccgccagaatttcaaagctattattgttagacatttattccctcttatatcatatggttacgtatatgacagacgaacagcaatcgacattttcaaggtggatctggtcggtaagcgccacttcttctccggtaagaagatcgcgataacgacggttagccagggccgcaggcaggttgaccgccgtctgtggccatcgttgcggggcagtcagcgcgtcgctcgcctgctgcattggcagcaccagtcgcggcgcgatgacgatcagcgcatcattaccctgctgacgggcgaaggcgatcaggtgatcggcgttatcgccttttgccgccagcggcacatagtcgccacggcggaacagatcgggtttacgctggcgataatgcagcacatgggtgatcacctgttgcttgagcgcgccgctcatccagtccgcttctgacgtcggcacaggctcgtcatcgctgaacagatgctgctcaagagcggcaaagtccggctcgcggcggttatctggatccacaaggctgaagttgagggtttcgctgccctgataaatatccggcacgccgggagcggtaagcttgatcaccgtctgggtcagactgttgaccaggcccgcgcggacaaagggttgcagcgtctggtaaaaatcttccaggaaagcctggttgtccggggagagcagatgacgggcatagtcgagcaccacggtttcatagacgtcgttgctgtcggcccagtcagtgcgcagcttcgcttcacgcagcgccttttccacaaacggaataaagcgttcttccagcgccgctaaaccggcggtgtcctggggcgtcagcgtcaccggccagacgcccgccagcgcctgatacagcatccaggcgagttccggttttggcgtcgggccatcgaacagcacggtgactttgctgtcgttcatctgatgccagcgtgccacgtgcgccgcccattcctccggcgcttcggtgagggtatagagccgtgcgcgggcatcctcaccgcgtttggtgtcatgggttgaggtgcccgacagcgcatccggctgccgttcaagacgggttttcatctcggcgtggaaacggtcgagggagaagacgcgcggtaacggttcagcgcccacttcgttaagggccagatccaggtgctgacggaagaacagcgtgtcttccaccgattttgccatcagcggcccggtaagctgctggaaacgggtgcggaaagtggcggcagccggatcagcgctggcaagaatgcccgccacgaaatcaagcgcttcggtatccggggcgtaatcgctgttttttacccgcgcaaccactttttgcagcagttgctggctggcctgcggcaggccgctggcggtgccataggtacggtaaaccgggaaggccaccagcagttcgcgcagggcggcgcgcaccaggctttcatccagcgtgcggttttgcgtggcggcgatctccatcgccaggcgcagcagggtggtgaattccccttcgaaattgcgatccgccatcagcagcttggcggcgcgcagctcggctttcatgtccaccggtttgccgaccgcctcgtcgtaggcctggcgcagcgcgtccagcttatcgtcatccaccagcacgtccgagagtgcggcaataaactcatagccggtggtgccggagatcggccagtcttccggaatgtgctcgcccttgccgaggattttttcgacggtgatgtagcactccggtccggcggtctcacgcagccgcgccagataggcctgcggatccgcaaggccatccacatgatccacccgcagtccgtccaccgcgccggaatgcaccagttcgaggatcagccggtgggtatcatcaaatacggtgtcgtcttccacgcgcaccccggccagcccggtgatctcaaagaagcggcggtaggagagatcgcgcggcgcatcgcgccaggacattaaccgccacggctgctgatcgtgcagcgcggcgatgtcagccttgtcggtcagcgccagcacctccgcttcgcgcccctgccagctggcgggcgtcagcgggtaaaagttgtcgaaataggccagcgccggacggccggtttttggatcgggcttgacgctgatctcatcgttcgccagcaccgcttcaaaggtatcgccgaggaacggcagggtcaggcggcgcgaccagtcgatatcgaaatgccgcgcgtaacggctgtcttcgccatgttcgatcacatcgcgccaccagggattttccagcgaggcggccatatggttcggcacgatatcgaggatcaaacccagaccggcggctttcagcgcctgcgccatgcggtcaaagccttcgcgcccgccaatggtcggatcgatttcgttggcgtcggtcacgtcgtagccgtgggttgagccgctggtggcggtaaacaccggtgaagcatagagatggctgatgccgagccgtttcaggtagggcaccagcgcggcggcacgatcaaaggtcatgccgttgcggaactgaatacggtaagtcgaggttgggatactcacgatacatctcccggggcaagacggacaataatggaatcaggcggcagatccgccgccggggagcgccagacatagatggtctcgccgggttgatccggcagcggctggtgccggtcgctgatattgagcgccatggagagcgtaccctgcgggaagcgccagctgacggcgagataaccttcagccgtctccaccaccttaccgctgttgccgcccgccgttgccagcagcgggacaatatactgcttacgcacatccagcagcgcctgggtaaaggccagccactcctcgccttccggcgtgtccagcttctgccagtcaagttttgaacgggcaaaggtctgctccgcattaggatccggcacgctttcgccttcatgacccgcatggccttcaaactctttcgcgcggccttcccgcaccgctttcgccagatcgccatggaaatcggtgaagaacaggaacggcctggtttcgccgtactcttcccccataaacagcagcgggatatgcggcgataacagcagcatcgccagcagcacgcgggtgcgctctgcgcccgccagggaaatcagacggtcgccctgggcgcggttgccggtctggtcatgattctggatgaaatccacaaaggcggtcggcggctggtcggtacttttcacgccgcgcggctcgccggactgcaccgaaacttcaccctgataggcaaagccttccgccagcgtacgcgccaccagcttttccggctcgcgggcaaaatcctggtaataggcgtgggtttcgccggtggcgaagacgtgcacggcattgtggaaatcatcgttccattcgccggtaaacagcggcaccgaaccgtctttttcgcgcggatgcaggaaggtgacgttacggcagtcttccgtggtcagatgcactggccgatcggtgatgcgcttgcggatgcgttcggcgatctcaatcagcagatgtttctctgaggtatcttcgatctgatcgatggcgtcaaagcgcaggccgtcgaggttgtactcttccagccagtagagcggcgcttccagcatatagcggcgggcagcgtccacatcataggcgatgcctgcgccccagggcgtatggcgctctttatggaagaactccggcgacagcagcggcagatagttgccttccggcccgaaatggttaagcacaatatccagcaccaccgacagcccgtggccgtgggcggcgtcgataaaggccttgaaatcgtccggcgaaccataggccgcatggggggcgtacagcagcacgccgtcatagccccagccgcggttgccgccaaactgcgagacgggcagcacttcgatcatggtgatgccggtttgcgcgaggtacggcagtttgtcgatggcggcgcggaaagtgccctccggcgtaaaggtgccgatgtgcatttcgtacaccacgctttcttcccatgcccggccctgccagtcggtgttctgccaggcatagtgtgccggatcgacgaccagcgacgggccgttcacatcggctttttgcgcgcgggaggcgggatccggcaccgccatgccgtcaggcagcacatactggtattccgcgcccggcgcgacgcccggcaccgtcagttcaaaccagccgtcgcccaccgcgttcatttctttgtcttccccggcaagccggagcattaccctcgggtgaccggaagcccacagacgaaaacgcacgccattggcctctgtgtattcggccccccaactcttcgtaaaggtcctggacgacatacaattaccccgtatagctcatcagtgagcacagaattgatgtgcaatggtcacgttccccacagcagttgcaaatcaatcatagttcagatacggcaactgaaagggcttctgataaagaagagatccgggcggtcgggcggcgtctgtgggggcggatggcgcttttgtgataaagctccggaccaaaaaccttaccgctatccatacttaccggcgatgccaatgaaggagggacacagaatgcgctggcaaacccacaccgtttttaatcagccgttgccgctcaataacagcaatctttttctttcagacgcctcgctgcgtgacgccgtggcccgtgaaggcgcgggctgggacaccgagctgctggcaagtatcggtcaacaactgggcacggcggagtctcttgaactggggcgtttagctaacgttaacccacccgaactgctgcgctatgacgccaccggcgagcgtctggacgatgtacgttgccacccggcctggcacctgctgatgcaggggctgtgcgccaaccgggtacataatctggcgtgggaagatgaggcgcgggcgggatcgttcgtcgcccgcgcggcgcgctttgtgctgcatgcgcaggtggaggcgggcaccctttgcccggtaaccatgacctttgccgccacgccgctgctgcaacagacgctgcccgcgccgtttcgcgactggttaaaaccgctgttaagcgatcgctacgatccgcatgtcttacccggcgcgcaaaaacgcggcctgttgatcggcatgggaatgacggaaaagcagggcggatccgacgtgctgagcaataccacgcgggcggaaaaaagcggtgatgtttaccggctggtgggccataaatggtttttctcggtgccgcaaagtgatgcgcatctggtgctggcgcaggccagcggcggtctgtcctgcttcttcgtgccgcgttttctgccggacggcacgcgcaacggcgtacgccttgagcggctgaaagacaagctcggcaaccgctcgaacgccagcagcgaagtggaattccatgacgcctgcggctggctgctgggcgaggagggggacggcgtacggcagatactcaagatgggcggactgacgcgcgttgactgcgcgctgggcagccacggcctgatgcgccgcgccttttccgtggcgctctatcatgcgcaccagcgccaggcgttcggcaaaaatctggtcgagcagccgctgatgcgtgacgtgctcagccggatggcgttacagctggaagggcagaccgcgtttctgttccatctggcgggcgcgctggatcaccgcaccgatcccgaggcggcgctgtgggcgcgactgttcacgccggtggcgaaattcgccgtctgtaaggcaggtattccttttgtggcggaagcgatggaagtgcttggcggcattggttattgcgaggagagtgaactgccgcgcctgtaccgcgaaatgccggtcaacagcatctgggaaggttccgggaatatcatgtgtctggacgtgctgcgcgtgcttgcaaaacagcatggcgtaatggatctgctgacgcaggcgttcggcgaggtgaagggccaggatcggcattacgaccgcgcctggcggcagttgcagcggctgctgcgcaaacctcaggaagcccgggcccgggagatcgcgcaacagctttaccggctggcggccggggcgcagatgctgcgccacgcatcgccgccgctggcgcaggcctggtgtcagatgatgctggatacccgtggcggcgcgctgataaacgagcaggtgcagaatcacctgctgtcgcgcgccacgggcggcgtgggttaaaggcggaacaggctgaccagctgactcagatggctgcctttttcccgcagcgtgcgggcaatatcttcactgcgtgatgcacgatcggcggtgatgtgcgtggcttcgccaatgtgcgtcatcgccagattcacctggccgataccggcagactgttcacgtgaggcgtggttaatctcggtcaccagctgattaatgttgcccatatgatcgatgatcgccgacatcgccttctgcgtctgttccgacagggcgtggccttccgacactttcgccagcgtatcggcgatcagctcctcgatctctttcaccgcctgcgcactgcgcgccgccagcgcccgcacttcctgcgccaccacggcgaaccctttgccatgctcgcctgcccgcgccgcttccacggcggcgttcagcgccagaatgttggtctggaaggcaatggattcaatgacctgagtaatggcggcgatacgctgggaggcgtcacgaatatcattcatggtcgccaccgcgcggctgacggtctggccgccctgctgtacagcgccggaggtgtcatgcaccagacgctgggtctgatccatgttttccgcggtttgctgtaccgtggccgccagctgttccatgctggcggaggtttcttccacgctgctggcctgcttgttgatctgctcggtgatctctccgctgtcggcagccagggtggtggtgccctgattaatctcacctgcggcttcgcgtacctgatgcaccatgttttgcagaccgtgaccgatgccgttaatggcctcgatcagctggcccacttcatccttgcttttcactgccagcgtggcgcgtaaatcacccgaggcatagtgctgcgccagctgaataacatcccgcagcgggcgggtcagccagcggcggatgatcaccacaaagagcgcggcaaacagcagcgagatcaccactccggcgatcaggaactgattgcgcatggtgttcacatcgcgcagcagcacggctttgtccacttctccgacaatcgtccagttccagccgggcagggcgatccacgacatcatccgcgtacggccatcagcgtcggtgcgcgccagcgtgccggactcactgccgagcagcgctttctgcgtggcgtcatcccactgcgggcgcttgccttcttcacgcggatggaacaggtaattgccataatttttaccggcgttgcgatccagcacgtagaaatgtccgctctcgccgagacgacgttgcaggatcttatcgcgcatgatgccccaggaacggctgatatccacgccgacgaagagaatggcgatgatattgccgctggcgtcttttaccggctgatactgggtgatatagcgtttgccgaacagcaatgccaggccgcgataggcctcgccgcgcatgacgggagccagcgccgggctggcgctgtccagcttcgtgccgatggcgcgatcgccgttttctttacgcagcgaggtcgccacgcgcacgaaatcatcgccgctgcgcacgaacagcgtcgcaatagcgccggtacggttcagaaaatcgtccggtacggcattattttcgtgcagctcaatttcgccgccttttagcagcggcaccgttatgccctgaatagtacgggtttgcgtggtatccacgctgatcggctgcggaataaaactggtgaataaacgcgtgtagctctcaacttcttcactgaggctggtattgaacatctcgaccatatccactacaccggtggactgactgtgaagatcttcaacggcgagggtttcgagctgttggctggcgttacgactcatcaggaaggtgaacaacaggaaaagcacagcaacgctcacgcctgtcatcagagaaagcctggtgcccagaccggcatggcgaaaagacgcgttcataaaatatccattgatcgaaaggtgtgcgtcgttcaacggcagctacgcgctaatatttagtgaatctatgtaacaaaaagtaacaagaaattattgacttagtaacagtagggtaattaaaaaccaacaaaaagaaaagccaccattaaaggtggcttcggagagctaggcataaagtatggcctgcacgcgccagttatcggcccgtcgatcctcctgcatcgcaataatgcgataccaggacgcgccctgctcatccgccttaaaggcgatgacccgttccacatcctgtgcactgccataaacattatttactgagatcaggccgatttcattaagcccggtgacgcaatcggcactggcgaattcggcggactgcgccgttgtgctcactaaacccagtgagagcagcagcgtggttaaggcaagcgatcgtttcatttgtcagctccatttaacgttaccctgagtcatggcagggcaatccatcgcgtataaatcctctcccttgccgaagcatcgaatttattgtgcacaggaatacgtctaaaggtgcaaagcagtgtaaatcaaccttaaaaaacaatgcgccgttactgacgatacaaaatggcctgtgaataccactggccggtaaaaacagtatcgtcattgagaagaatgacgtaataatccgctttagctgcggcggctttggctttgatttccgcctccgcatccatcggagagcctttaaccatcacgctgatggtgcctaaacgctgtaaaccttcagtctgattgcggctgatctcctgcggctcactcttcgccggaggcgggggctgcggtgtaccctgtaatgcgctacagccgctcagtaataatgccagtacaacaggggcgaaccggctcattgttgtttctcgtttcctgattggcatagtgtagttcctcgtgaatttccctttgggggaatgttcccgaaatgttatctgaaacgtgatttttgactaaaaatcacccgaaagcgtaatggacgtctcaccattatggcaaaacatcgtcgatcgtggtttgtgtgacgtcaccctgcgtggcatatcggcaaaataaagcaggagagcctgatgattgaactggaaacgcggcagtttgccggcattgaaacccttcacgccacgcctgccggacagcgcgctcagccgctgccgacggtggtgttttaccacggctttagctcatcgaaactggtgtacagctattttgccgtcgcgctggcgcaggcgggcataagggtggtgatgccggacgcgcgggatcacggcgcgcgctttaacggcgacgccacggcgcggctcggacagttctggcagatcctgcacagcaatttacgggagtttgacccgctgcaaagggcgctttacgacgccgggctgattaaggatgcccggctggcggtgggcggcgcgtcgatgggcggcatgacggcgctgggcatcatgacgcggcatccggaagtgaaatgcgtcgccagcctgatgggatccggctattttacgacccttgcccgcacgctgttcccgcctgcggatctgcaacaggccgtagcgccgcttaccgactgggaagtttcccggcatttaccccgtctggcagaccggcccctgctgctgtggcacggcgaggaggacgacgtcgttccggcagtcgaaacctggcgattacagcaggcgctgacgcaggccgggctggatcagcagctaacctgcgtatgggaagcaggggtgaaacatcgcattacgcccgttgcgctggacgctaccgtcgatttcttccgcgcgcacctttaaacgcacatcacctgcacgccctggctctcaagctgtctgatgatgtcagggttggcctgtttgccggtgatcaccatgtcgatttgatcggcgcggctgaacagcatcccggcacgttcgcccactttgctgctgtccaccagcaccaccagctttccgaccacgttcagcattttctgctccgccatggcggtcagcatatccgttttgtacagcccgtcggcggccaggccttttccgctggtgaacatccagtgtccggcatagaggctgttttcactgccctggggactgagggtgatggcctggcttttgttgtactgcccgcccatgatcaccacgctttcgtgctcctgatcgatcaggtaattcgccagcggcaggtaattagtaatgatttgcaccggcttgccgcacatttcgcggcccagtaaaaaagcggtggagccacagttgatcaccacgctctcccccggattgaccagttgcgacgcggctttggcgatacgtactttctcatcaagattttgcgcctgatgaatgttcatcggcgtccagcgcgggcgctgctggctgatggcctcggcaccgttgcgcacctttttcagcttgccgctctcgtcgagcttgttgatgtcccggcgcgcggtggcaggggagacatccagccgcgccatcacctgctcgacggtgataaaacccgtctgcgccagtagttccagcagaatttgatgtcgttgcgcttctgtcatgagctattccgattggtgatgatttttttagatgatatttgaaatagcctgcgattactaagcgttaataaaaaaatgccggcccggcagcacaggccgccggacgcgaaacctgtggcgatcacaggaaggatttgaacggtaaatcaggctcaatggtaaagcagtcgtcaaagccgcgcgggtagtgatattcaaatttgtctttatccagcggccaggtaaatttaccgcccacctgccagatgaagggtttgaagccatattgcaggcgatcctttttcatctcccacagcacgcgcagctcctgcggatccgcctggaaattcgaccagatgtcgtgatgaaaggggatcaccactttggcgttcagcgcttccgccatgcgcagcagatccacgctggtcattttgtcggtgatgccgcgcgggttttcgccgtacgagccgagagccacgtcgatctgatggtcgttgccatgcttcgcataatagttcgagtagtgcgaatccccgctgtgatagagcgagccgcccggcgttttaaacaggtagttcaccgcgcgttcatccatgccgtccggcaggatcccggcggcttgctgatccgcgggcagggtgatcaatgccgtgcgatcaaaagcgtcaagggcatggatctcaatatcttttatcttcaccacgtcgcctggtttcaccacgatgcagcgctcgtgcggcaccccccagctaacccacagatcgacgcaggtctgcggcccgataaagggcaccgtctgcggacagttttgcatgaccgccgccgccacgtttacatcgatatgatcgttatgatcgtgggtggcgagcaccgcgtcgatctcgcggatggcgaaaggatcgagcacgaaaggcgtggtgcgcagattcggctgtagctttttcacccccgccatacgctgcatctggtggccggttttcatcagcggattgccgtggctttgtttgccggtaccgcaccagaaatccacgcagacgtttgtgccgccctctgacttcagccagatgccggtgcagccgagccaccacatggcaaaggtgcccggcgccacctgctcctgctcgatttcttcattcagccagcttccccattccggaaaagtgctgaggatccatgattcgcggctgatgctttccactttgctcattctgtactcctcgctttttatgtcaaatgtaatcataaaatgatttattgtgatttatgttgtcacgcttttttcagcaatgcaacgaggtggtttgcagaaattgtgcgaggcgcgttcaggttttgcgcggtttatatcgtggaagagcagatctgttttttatatctctctgtaaatgatattaattttttgccatgacgaatagccactcttggtatgaggaaataaattgcgcggcgcatcacaaataatcaaatgcaatctttttgtgattatttttgattgttagagtgtgcgcacacccggtaccgatgcccggtgccctttaccctccggagagagttatggagatcctctacagcgtctttaccgttttctttaaccaggtcatgaccaacgccccgttgctgttgggtatcgtcacctgcctggggtacatcctgctgcgtaaaagcgtcagcgtgatcgtcaaaggcacgataaaaaccattatcggcttcatgctcttacaggcgggatccggcattctcaccagcacctttaaaccggtggtggcaaaaatgtcggaggtgtacggcattaatggggctatctcggacacctacgcctcaatgatggccaccattgaacgcatgggagacgcctacagctgggtgggatatgcggtgttgctggcgctggcgttaaacattttatatgtgctgttccgccgcgtgaccggcattcgcaccattatgctcaccggccacattatgtttcagcaggccgggctgatcgccgtgttcttctttatcctcggctacccgatgtggaccaccgttatctgcacggcggtgctggtgtcgttgtactgggggatcacctccaacatgatgtacaagcccacgcagcaggtgaccgacaactgcggcttttccatcggccatcagcaacagtttgcctcctggctggcgtacaagctcgccccttacctcggcaaaaaagaggagagcgtggaagatcttaaactgcccggctggctgaacattttccacgacaacatcgtttccaccgccatcgtcatgacgctgttcttcggcgcgatcctgctctccttcgggctggatgtggtgcaggcgatggccggtaaaatccactggactatttatatcctgcaaacgggttttcagttcgcggtggcgattttcattatcgtgcagggcgtaaggatgttcgtcgccgaactctccgaagcgttcaacggcatctcccagcggctgatccccggcgctgtgctggcgatcgactgcgcggccatctacagcttcgcgcccaatgcggtggtgtggggctttatgtggggcaccgtcggccagctgattgcggtgggtatcctgctggtgtgcggctcctctattctgatcatccctggttttatcccgatgttcttctctaacgccactatcggcgtcttcgccaaccacttcggcggctggcgggcggcgctcaaaatttgcctggtgatgggcatgatcgaaatctttggctgcgtatgggcggtaaaactcaccggcatgaatgcatggatgggcatggcggactggtcgattctggcgccgccgatgatgcagggcttcaccctcggcctgtggtttatgggcgtcattatcctgattgcgctggcgtacatgttctttgcaggacgggcgctgcgtgcggaagaagatgcagaacaccctctggcagaaccttctgcccaataaaaggagtagagcgatgactgtacgaattctggcggtatgtggtaacgggcagggcagttccatgatcatgaaaatgaaagtggatcagttcctgacgcaacagggcgtggaccacagcgtgaacagctgcgccgtgggcgaatacaaaagcgagctgggcggggcggacgtgattatcgcctccacccatattgccggtgaaatcagcgtcagcggcaacaaatacgtggtcggcgtgcgcaatatgctgtcgcccgctgatttcgggccaaagctgatggaagtgatagccgcgcactttcctcaggatctgaagtaaggacgcgccatgaaattacgtgattcgctggcggaaaataagtccattcgtttgcaggccgaggccagcagctggcaggaagcggtgaaaatcggcgtcgatctgctggtggccgctgacgtggtggaaccacgctattaccaggccattctcgacggcgtggcgcagttcggcccgtattttgtcatcgcgcccggccttgctatgccccatggccgcccggaagagggcgtcaggcgcaccgggttttcgctggtgacgctgaaaaccccgctggtgtttaaccatgaggataacgatccggtggatatcctcatcaccatggcggcggtggacgccaacattcatcaggaggtgggcatcatgcagatcgtcaacctgtttgaagatgaagccaatttcgaccgcttacgggcctgtcgcactgcgcaggacgtgctggatctcattgatgccgctgatgcggcggccgtttaagagggacttactatggcattacctatgttgcaggtggcgctggataaccagacgctctcccacgcctatgaaaccacccgtctgattgctgaagaggtggacattattgaggtcggcaccatcctgtgcgttggcgaaggcgtgcgcgccgtgcgcgatctcaaggcgctctatccgcacaaaatcgtgctggcggacgccaaaatcgctgacgccgggaaaatcctctcccgcatgtgtttcgaggcgaatgccgactgggtgacggtgatctgttgcgcagatctgaacaccgccagaggcgcgctggacgtggcgcaggagtttaacggcgacgtgcaaattgagctgaccggttactggacctgggagcaggcgcagggctggcgcgatgccggtatcaggcaggtggtgtatcaccgcagccgggatgcgcaggcggcgggcgtggcctggggcgagtcggacattgccgccatcagacggctggcggagatgggctttaaggtgacggtcaccggcgggctggcgctggaggatctgccgctgttccagggcattcccatccatgtctttattgccgggcgcagcatccgcgatgccgcctcgccggtggaagccgcccgccagttcaaacgcaccatcgcacagctgtggggctaaggagcggctatgttgtcgaaacaggtgccgctcggcatctatgaaaaagcgctccccgccggggagtgctgggctgaacgtttgcagcttgccagaacgctgggttttgattttgtggaaatgtccgtggatgaaaccgacgcccggctttcgcgccttgactggagccgtgagcaacggctggcgctggtcaatgccattgccgaaaccggcgtgcgggtgccgtccatgtgcctgagcgcgcaccgccgctttccccttggcagtgaagatgaccacgtgcgtcagcaggggcttgcgatcatgcgtaaagccatccagttcgcgcaggacgtcggcatccgcgtgatccagctggcgggctacgacgtctattaccagcagggcagtgacgaaacgcgccgccgctttcgtgacggactaaaagagagcgtggtcatggcgagccgcgcccaggtgacgctggcgatggagatcatggactacccgttgatgaactccatcagcaaagcgctgggctacgcccattacctgaataacccctggttccagctctaccccgacatcggcaacctgtccgcatgggataacgacgtacagatggaactccaggccgggagcggacatatcgtcgcggtacacgttaaagatacccgcccgggtgagtttaagaacgtgccctttggcgaagggattgtggattttgaacgctgcttcgccaccctcaggcagagcggctactgcgggccgtacctgattgagatgtggagcgaaacggccgcggatccggcagccgacgtgatcagggcgcgggactgggtacgtgagcgcatggcgcgggccggtttacaggaggcggtataatggaacgactcagacagcaggtgtacgacgctaacatggcgttgccgcgctacgggctggtgacttttacctggggcaacgtcagcgccattgaccgcgaacgcggctgggtggcgatcaaaccgagcggcgtggcgtatgaaaccatgacgcctgacgatatagtcattgtcgatctcagcggcagggtgttgcacggatctcttcatccttcctcagacaccgccacgcatctggcgctgtaccgccgttattctgccctcggcggcgtggtgcatactcactcaacccatgccaccgcctgggcgcaggcaggacgggcgatcccggcgttgggcactacccacgcggattactttgccggagatattctctgcacccgcgcgttaaccgaacaggaagtacgggaagagtacgaactcaataccggcagggtgattattgaaactttgggcgacgccgatccgctgcatacgccggggatagtggtgtatcagcacggcccctttgcctggggaaaagacgccgctgacgcggtgcataacgcggtggtaatggaagaggtcgcgcgcatggcgtggattgcctacggtattaatccgcatttaaagcccatcgacgaccacctgctggagaagcatttcctgcgcaagcacgggccggacgcctattacgggcagcggtgatcaccgcgtagacccgttttacgcggtgtgcgaattatttgtgcaattagcttgagttcggtgggcgtcgcaagtatgattacgcgtcaatttttcagccgcctttcaaacacgttccttgcttccatgggccgcggctgaccctgacaggaggctgaataatccgtaaggagcaattcgatgcgtcattacgaaatcgtttttatggtccatcctgaccagagcgaacaggttccgggcatgatcgagcgttacactggtgcaatcactgcagcagaaggtacgatccaccgtctggaagactggggccgccgtcagctggcttatccgatcaacaaactgcacaaagcccactacgttctgatgaacgttgaagcgccgcaggaagcgatcgatgagctggaaactaacttccgcttcaacgatgccgttatccgcagcatggttatgcgtaccaaaaacgctgttactgaagcatctccgatggttaaagcgaaagacgagcgccgtgagcgtcgcgatgatttcgcaaacgaaaccgcagatgctgatgatgctggggattctgaagagtaatttctgatgaccaaccgtctggtgttatccggcaccgtgtgcaggatgccccttcgaaaggtcagtccatcaggaatacctcattgccagttcgtgcttgagcatcgttctgtgcaggaggaagccggtttccaccggcaggcgtggtgccagatgcctgtaataatcagcgggcacgagaaccaggccattactcacagtataacggtcggtagcgcagtcaccgttcaggggttcattagttgccataaggcaaagaacggactgacgaaaatggtactgcatgccgagcagattgatttgatagattctggagactagccaaatggcacgttatttccgtcgtcgcaagttctgccgtttcaccgcggaaggcgttcaagagatcgactataaagatatcgcaacgctgaaaaactacatcaccgaaagcggtaagattgtcccaagccgtatcaccggtacccgtgcaaaatatcagcgtcagctggctcgcgctatcaaacgcgcacgctacctgtccctgctgccgtacactgatcgtcatcagtaatcggtcacggtccattaatacgactttgagaggataaggtaatgcaagttattctgcttgataaagtagcaaacctgggtagcctgggtgatcaggttaacgttaaagcgggttacgctcgtaacttcctggtaccgcagggtaaagctgttcctgctaccaagaaaaacgttgaattcttcgaagcacgccgtgctgaactggaagccaaactggctgacgttctgtccgctgctgaagctcgcgctgagaaaatcaacgcactgggcaccgttaccgttgcgtctaaagcaggcgacgaaggtaaactgttcggttccatcggtactcgcgacatcgctgacgctgtaactgcagctggcgttgacgtggctaagagcgaagttcgtttaccgaacggcgttctgcgtaccactggtgagcacgaagtgagcttccaggttcacagcgaagtgttcgctaaagttatcatcaacgttgttgctgagtaatctgcaacccacgttttgataacaacgaaacgccggccttgtgccggcgttttgcttttctgccttctactattctgatcctgtactgactggctattgcttaaccttttcgcgataatagaaaaataaaacattattttattttttggtgaaggaatggacacaagccaccagccgcctctgtttgcccgcaaaaacgtcgtctatatgggcgcagcgttctgctgcctgctctggggcagcgcctatccggcgatcaaaagcggctacgagatttttcagatcgccaccgacgatatcccgtcaaaaattgtctttgccggttatcgcttcctgtttgccgggctgttactgctgctgttcgccatgatgcagcgtaaacccatcgcccgtctgagcggtcgccagtatgggcagctcgccgtgcttggcctgacgcaaacgtcattgcagtacatcttcttttatattgggcttgcgttcaccaccggcgttaaaggctcgatcatgaacgccaccggcactttcttcagcgtgctactggcgcatttcatctaccagaacgacaaactgagctacaacaaaacgctcggctgcgtgctgggctttgccggggtgatggtggttaacttcaacagcggcatggatttcagcttcacgctgatgggcgacggctcggtggtgctggcggcgtttattctctcggccgccacgctgtacggcaagcgcatttcgcaaacggtggatccgacggtgatgaccggctatcagctggggatgggcggtctggcgctggtggtggggggctatctcacgggcggctcgctcaccctgcacggcttcgcctcggtggccattctgggctatctgacgctgctctcttccgtcgcctttgcgctgtggagtattctgctgaaatataaccgcgtgggcatgatcgcgccctttaacttcctgataccggtgtcgggcgcggtgttgtcggcgattttcctcggcgaaaacatcctggaatggaaatatgcgctggcgctggtgctggtgtgctccggcatctggtgggtgaataaagtaaaaaaggggaacgcctgacgttccctctctgttcaacacattaataattaacgcgcgcggataaagctgccgtccgtctggcgggtaaacagcacctgctgatcgccgctggcttcgatggtcagccctgtgaccacgccgttggcgttctggcggattttcacaatctgccccgtttgcaggttgctgagcggcttaccattgccttcaacctgcgccatcgcatagacatccgtcggcggcagattatggtcgcggaacagctgcgccagcgttttacccggttcgacgcgataggtgcgccactgctgctcaatgccggtcggctcctgcaacggcgcgctgttctgcgtggtcggcggctgttcctgttcttgctcctggatcggctctggcgcaataggcgccacctggccgtcgttttgcggcgacgagaccagcggcggctgttcgggctgcgcagtctgttgcgactgaggctgtgactgcgactggagatcaagttgcgcatcgcgggtggaggacgacacgtcgctgtcgtcggtacccggcagcaggaacccgataacgatcagcgcagcggcgaaaataatgccacggcgatggcccggcggcagcggatccatgatgcgcacgttgtccggcgcgtgccagatcctcgccagggttggttttagttcaaatcgcccgggcatggctttcctcctgctccgcgtcgttagtatcctgtgtcactgagtatagtttgctaactgcctgatgagcgtagtaaagcacgctttcgtgacctcagttcgggaaaaatcttaccgccaccattgtttctttttccctgcgatttgtcatcaatccccgcgacaaagttttacccgtcgcagcctgactgttatgctgcccgctactttaaatgcgatgaaaggaaaacccatgacaaccccgacttttgacactatcgaagcgcaggcaagctacggcattggcctgcaggtagggcagcaactgagcgagtctggcctgcaggggctgttaccggaagcgctggtagcgggcatagctgacgcgctggcaggcaaacagccggcggtaccggtcgatgtcgttcaccgtgccctgcgtgaaatccatgaacgcgctgacgcagtccgtcgcgagcgctttgaagcgatggcgtctgaaggcgtgaaatacctggacgaaaatcgtgagaaagacggcgtgaacagcaccgaatccggtctgcagttccgtgtactgactcagggcgaaggtccgatcccggcacgtactgaccgcgtgcgcgtgcactacaccggtaaactgatcgacggcaccgtgttcgacagctctgtcgcccgtggcgaaccggctgaattcccggttaacggcgtgatcccaggctggatcgaagcgctgaccctgatgccggttggctcgaagtgggaactgaccattccgcagaacctggcgtatggcgagcgtggcgcaggcgcgtctattcctccgttcagcaccctggtctttgaagtggaattactggaaatcctgtaatttcccgcaaagtagccctctcccgtaaccgggagagggtattttctctccgcacatatgccgttctttagctcagagtcgatatttaatgttgcaaatgcatttgttgcgtgtatttttgtgacctgattcgcacagacgaagtgatataacactcagtttaaacataaatttaacatctcattcaaaacacagtattcatccctccgattcttacctactatcgatgagtcaaaaaaccaaggcattgtcacgcacgtgacactatgaaaggccagaagagcctcaacaacgcagacaggtacaggaataaatacatggtagatcaaacgaaggtcgccgctgaccagcaggctccggcggagcaatcgctacggcgcaatctcaccaaccgtcacatccagcttatcgccatcggcggcgctatcggcaccggcctgtttatgggctcaggtaaaaccatcagtctggccggcccgtcgatcatatttgtctatatgatcatcggctttatgctgtttttcgtgatgcgcgcgatgggcgaactgctgctgtcaaatctggaatataagtcgttcagcgatttcgccgccgatttgctggggccgtgggcgggttactttaccggctggacctactggttttgctgggtggttaccggcatggccgacgtggtggcgatcacctcttatgcacagttctggttccccaacttatcggactgggtggcttcgctggcggtgatcctgctgttgctgagcctcaacctcgcgacggtgaagatgttcggcgaaatggaattctggttcgcgatgatcaagattgtcgccattgtcggcctggtcgtggtgggtctggtgatggtgctgaccgaattcacctcaccgagtggcgtacaggcctctttcgcgcatctgtggaatgacggcggctggttcccgaaaggcatcagcggtttctttgccggtttccagatcgcggtgtttgcctttgtagggattgaactggtcggtacgacggccgcagaaacgaaggatccggaaaaatccctgccgcgcgccattaactccattccgatccgtatcatcatgttctacgtgttcgcgctgattattattatgtcggtgacgccgtggagctcggtagtggcggaaaagagcccgttcgttgagctgttcgtgctggtcggcttaccggcggcagcaagcattatcaactttgtggtgctgacttcggccgcctcgtcggcaaacagcggcgtgttctccaccagccgtatgttgttcggcctggcgcaggacggggccgcgccgaaaagcttcggtaagttgtcaaaacgcgcggtaccggcaacgggcctgaccttctcttgcatctgcctgctgggcggtgtggtgatgctgtatgttaatccgagcgtgatctctgccttcactatgatcaccacggtgtcggcgatcctgttcatgtttgtgtggaccattattctttgctcgtatctggtctaccgcaaacagcgtccgcacctgcatgagaagtcgatttataagatgccgctcggcaagctgatgtgctgggtatgtatggcgtttttcgtcttcgtgctggttctgctgacgctggaagaagatacccgtcaggcgctgatcgtcacgccgctgtggtttatcgtgctgggtgtgttctggttcttagtgggtaaaaagcgtatggcacgtatgcgccgctagtcacctgtaatgccggatggcgctgcgcttatccggcctggacaataatcccgttcacgtaggcccggtaagcgtagcgccaccgggcaacgtcgttactccccgcttaacgcccgcggaaacagcacattattttccaggctgatgtgctccatcagatcgtcaatcagttcattaatgccgttatacatcgctttccaggtggtgcaggcttccggcggcggcgtcacgttattggtggtgtgtttgatcacctccagcagttcccccgcttcatcatgttcgctctccatgacgttaatcggcccagcggcgtggctgcccatgccctgtttgatcatcgggaagaggatctgctcctctttcatcatatgactggaaagctcctgatgcagcatggtcaggtatttggtcaggccgcgcggcacgttgggtttatcggcatggacgcgctcgactttggtggcctgcaggatcagctccggcaactgttcgcggtggcgatcgtggtagcgcacaatgatgtggtcgatgatgtgaggaagcggctccacgcgccagtctttctccaccggctgttcggccagtttcgccagctgcgcttcaatcaccgccacatccagctccttacgagccgcggcacgtgccagcgtctgcttacccccacagcagtagtccatatcgtattgacggaacagggcagaagcgcggggaatggacagcgccagctcacctaaaggttgatcgcgaaaggccataacagttacctcgttagtcagaatataagatgcattttaaatgcatctttaagccgaggctataccccttatgagtgacgggattaatttgcccatttttgtgcgctgtgtcacaaaaaattcctgcttataacgtattgaaactacttgttaaagtgaagatttggtatcgagtgtgcaatatcttcgttaaacatgcgttaaaacctgccgatatagacccgtcacataaaaatcctgcatccgataaaaggttcccgatgtttaaacgtgtaaaagtaataaccctgttaataatggtgcttttcgtgctcggcgcgatgcaactgattgctgcgggtgtgtttatcaatgcgctcaacaatgacaaacagaattttaatgtttcccaggtctccagccagaacgtggcggaatttaccgatgcctggatcagcctgaaccaggcccgcgtgacgcttaaccgcgggatgttacgtctgcaaagcagcaccgccagccagatcaacggcggcgagctgggtgagctggtgaaaaccgcgaaaaacctgctggccgatgcgcagaagcattatgaaatctacgacgcgctgccggaaacgccgggtatggatcctcgtctgccgcccgagctggaaaagcagtacggcatctattccaccaccctgaccgaaatgaaccgcctgctggcggcgggcgatctggaagccatgttcaggcagggcgcggaaagcaaacaggtcgccatgcagagcgtctaccgcgaatggcgtgctgcgcaggctgagctggccaacaagggcgtcatcgataacgaaaatgattatgtgcgcatcatgtggatcctcagcgccattatgttgctggtggtggcggtgatcgtcgccagctggatcgccatgcagcgcgtgctgctgaagccgttacatgaagtaatggctcacatccgccacatcgcggcgggcgatctgacccatgaaatcgatgcggaaggcaaaaacgaaatggcgctgctggcgtcaaacgtacgtgaaatgcagcaggcgctggcgaccaccgtcagcgtggtgcgcgatggcgcggacactatctttaccggcgcaggtgagatctccgcaggcagcaacgatctctcctcccgtaccgagcagcaggccgcttcgctggaagaaaccgctgccagtatggaacagctgaccgctaccgtgaagcagaacgccgataacgcccgtcaggcgacgcagctggcgaaaaccgcctcggaaaccgcgcagaaaggcggcgcagtggtcgacggtgtggtgcgtaccatggatgaaatcgccaacagctccagcaaaatcgcgcagatcaccaatgtgatcgacggcattgctttccagaccaatattctggcgctgaacgccgcggtggaagccgcccgtgccggtgagcagggtcgtggctttgcggtggtagccggtgaagttcgcaccctggcaagccgcagcgcgcaggctgccaaagagatcaaagcgctgatcgacgattccggcagccgagtggatgcaggttcggcactggtgcatgaagccggtgaaaccatggcggaaatcgtcagcgccgtaacgcgtgtgaccgatatcatgggcgaaatcgcctcggcgtccgacgaacagagccgtggtatcgaccaggtgggtcaggcggtggcggagatggatcgcgtgacgcagcagaacgcctcgctggtggaagaatccgcggcggcggcagcggcgctggaagagcaggcctccctgcttaacgataccgtggcggtgttcaaagtgaaacgtcgcgccccggctgccgtagcaaacgcgcgtccggcggcggtgaaaatgaagccggttgccgcgactacagacgcgaactgggaaaccttctaagcctgatgcccggcggcgcaggcttgccgggcctggatggtggaactcctgcccggcggcgcatgcttgccgggcctacatgtcctacatgttcatcatcatgtaggccgggtcaggcgtagccgccacccggcactatcatccgttcaccactcgttttacccgtaccgcgatcaccacccccagcaccagcagcgcaatccccgacaccgtcaacagcggcggcacgctctggcgcagcaaaaaggtatacagcaagcccgccagcgtttcgaagacgatcaacggtccaaggatcaccgtcggcaatttctggctggccaggttccagcacagcgcccccacccatgaacacaaaatggcaatggcggtcatcaggccaataaataccagcgggcgtggaccaaacggcagcgcaaatcccggctgatccgcctgtaaccacacacaggccgcaatatagcccaccagcgacaccggtagcgtcaccaggccctgcgccgttgcccacatcatcggatgacgcgtgggattttcccgcagccagcgggcgttacgcagtgcataccacgcccagcacgccaccgacaccagcgccagcgcgatccccgaaccatagcgccacccgctgaaattcggcagcccgtgccgcagttcggcgatattcacacacaccagccctgcggcgatgcacagcagcgcgggcgcaaggcgcagccacggcagcttgccgtcacgcttgctgtagagcagattcgccagcaccggcagcaccaccggcagcgtgccgatgatcatcgttgagacgggcgcgccggtacgctgaatagcgctggcgagacaaacgtaataaaccaggttgcccgacagggtcagcgccagggcgatcaaccagtcatgacggcttaactgacgcagacgtacgcgccccagccaggccagcggcacggcgataagcccgagcgccagataacgtccggtcgactgcaaaatcgccggataatccggcaccagcagcggcccgacaaaaatcagtccccacattaaccctgcggccagggcgtacagcacaccactaatcatcctgccatccatattattcatgttgatcggcagtgtagggcagggcagagaaagaatattgtatgaggttgcgcatcagcggcgggcgacctgcttctggtagcgtaccggcgtgatgccataacggcgggtaaaggcgcgggtcaggtgcgactgatcggtcagcccggtcagggcggcgacatcggcggcgggcaggccgtgggtaaggaaattctttgcccgccacaggcggatcgccatcagcatctggtgcggggtgacgtgataatgggctttaaactgacgctggaaatggtacgggctgagggacgccacgcgcgccagttcgtcgagggtcagcggctgcatatagttatcatgcaggtactcccgtacgcgctcaaaacggtgcgccccttcggcactgaccggcgcatgacgggccagcggctgaaaagcgtcgatcaaatcgagcagataaccctgctgcgccagcgtgtcgtcgctatgccacagggcatggatcagggcgcaaatctgccgcgaacgcagcggatcgtgacgggaggcgtcagcaaaccaccagtggcggatgccggtgacctgctccagcaagtcaggctccagataaatcatgcgatagcgccagccgtcagcggtttccgcttcgccggtgtgcagttcatcaggattcatggtgacgacggagttcaccggggcgacgtgctgcgcgccgcgatagcgaaaacgctcggcaccggcttctatggcgccaataccgaaggcttcgtgggtgtgcggctcaaaggcgtagcgggagatatgcgcctgatacagctcgacgcccggcaactgcggcaggtgccgaaaacgggcgcggtctttctcatcgctgaactgttccggtacgccttgcacattcactctccgcctgggtcatgccttcattattaaggatgacccggcggcatgctacaaaaattaaccagtttgtaacagttacaggatggctttaatgctgtcggcaagcggcgtggtcgggcgaccaatcagtttgctgagcgtatggctgtcatcaaacagaccgccttttgacgcgccggtgtcggagtccgccagcaggctggcgaaggcgtccggcaggccgacaccgcgcagggcggcggcaaaatcagcctcgctgaggttctgataaacgacgtttttaccgctctgcgcagacagttccgccgccagttcgctgagcgtccaggcctgatcgcccgccagctcatacaccttaccggcatggccgtcttcactgaccacttttgcggcggcagcggcgtagtcttcccgggtggccgaggcgattttgccgtcgcccgccgcgccgataaacacgccatgctccagcgcaggcggggcgctggcgaggtagttttcactgtaccagccgttacgcagcagggcgtaaggaatgccggaggcggcgagcagtttctccgtttcgatatgttctgcggcgaggccgagcggtgaggtatcggcatgcagcaggctggtataggcgataaaaccgacgcctgcggctttggctgcgttgatcacattgcgatgctgggcagtgcgctggcccacttcgctggaggagatgagcagcagtttctcaacgccttcaagcgcgcgggttaatgccgcttcgtcgccgtaatccgcctgacgcaccacgacgccctgttgcgccagcgcgtcggctttcgcggggttacgcacaatggcgacgatctggctggcgggaacggttttttgcagggcggcgacagctaactgaccaagctggccggtggctccggtaatggcaatcatggaaaactccttcgtctctgggttgtgttatgagacactatcaccctgactcacttttagtaagtacgtacaaaaaggttagtatgaagaaaattgaacgtcctgccacgctcagcgagcagctgcgcgacggcaatttattcgccgagcagtgtccatcccgggatgtgcttaaacatgtcaccagtcgctggggagtgttgatcctggtggcgctgcgcgacggcacgcaccgtttcagcgaactacgccgcaagatggggggcgtcagcgagaaaatgctgtcgcaaagcctgcaatggctggagcaggacggctttatcaatcgggtgtcctatccggtggtgccgccccatgtggagtacagcctgacgccgctgggcgagcaggtgagcgagaaagtggccgatctggcggactggatcgagctgaatctgccgcaggtgctggcgcttcgcgacgagcgtgctgcgtaaagtgccgggtggcggtgcgatatatgccgggtgtcggctgcgcctaacccggcctgggggacggtgaacatgtaggcccggcaagcctgcgccgccgggcgttgtgtcggttgatgtgcggcgtggcttattttccgcctaaatccagctgataaattgcgaaaccgatgtcgtcggtgccggtatttttcatcggatactgcgctttctctttgataaaggccgccgctttttccgacggcgaggtctcaaagcgaatatcgagcggcgttttactgtggataggggccagacgccagttattatccgccgccgggtggatctcacccgcgcgcgccgactcgtcgccgatccacttcgccagcacggcgcggttttcatccggcgacgcgaacgcgatatggctgtcgccggtaccggcaaatttgccgccgtaagcgcggtagttattggtggcgacgaggaaagtggccgccggatcgacagctttgccgttgaaggtcagatccttaatacgctccgctttcgggttcacgctctggcattcaccgtcgtaacgcgcgggctgcgtgatatcgatctgatacttcacgccgtcgatgacatcgaagttataggtgcggaaaccgtcccagttgatcagcgactgcggtttgctgctgttcacatcgatctgattaaactgcccggcggagcactccagccactctttcagttcgctaccgctgactttcaccaccaccagggtgttcgggtacagatagagatcggcggcgttacggaaggtgagctggcctttttccacctcaacaaagctcgccggatcgtttttacgaccacccactttgaacggcgcggcggcagacagcaccggcagtttcgccagatccggatcgccctgaataaaatgctcaacgtaggctttttgcgcgttgttcaccacctgcaccgtcggatcgtcctgcaccagcgccagatagctgtacatgttatcggcggatttgccgatcggcttgctgacaaactcccgcgtcgcgtcgtggtcatgcttcagcacgtccaccagtttgctgtcttcagcggccagcgattttttcgccaccgcgtcgtaaatcggacgcgcttccgctttcgactgcgtgacctgccatttcccgctgtcattgctcagcgtcagatccaccacgcccagatgatcgccccacatgcccggcatcaccgacggcacgccgtttagcttgccgttctccacgtccgcgcccttaataccggcgaagtcttttgacgggaagaccgcatgagcgtggccgaacagaatggtatccacgcccggcacctggcttaagtagtacacggagttttccgccatcgcctgatacggatcggcagacaggccggagtgggcgaccaccaccaccagatccgcgcctttttcacgcatctcaggcacataacggcgcgcggtttcggtgatatcgttgaccgtcactttaccgtcgagattggctttatcccaggtcatgatctgcggcggcacgaagccgatataaccgatacgcagcgtatgatctttaccgtctttatccttaaccgtggtttctttaataaggtaaggggtgaacagcggttttttggtcttaacgtcgatgatattggcgttaacgtacgggaatttcgcccctgccagcgcattgtgcagaaaatcgagaccgtagttaaattcgtggttgccgaggttgcccaccgcataatccagcgtatttaacgccttataaaccgggtgcacttcgccttttttcagtccgtggctggcgacataatcgccgagcgggctgccctggatcaggtcgccgttatccaccagcacgctgttagtggcttcactgcgggcggcgttgatcagactggcggtacgcaccaggccgaacttttctgtcgcgctatctttgtagtaatcgaagtccatcatattgctatgcaaatcagtggtttccataatacggagatccaccgttgcggcctgcacgctggcggcgatcagcgtggccaggagcgttgcgctaaacttaatcatcagagatgtcctttttaagatctaagccacaaaagagaatgtatttacattttgttgcttacagaattgtgaatcttgccataaaagttgccatggaaaccggaatcactatcacagatggcggatccctttatgatgcgatataagtaaaacaacgagttaacccactgaaataaaaaagaggtggacgatgttagatgcaatttgtcagcttgcccgcgaggcaggggatgcgattatgcaggtgtacgacggccatcagccgatggacgtcaccagtaaaaccgatgactcacccgtaacggcggcagacattgccgctcatcaaattattgtgcaggggctggtggcattaacgccggatattcctgtgctctcggaagaggatccgccgtcctgggaaattcgtcagcactggcagcgctactggctggtggatccgctggacggcaccaaagaatttatcaaacgcaacggcgagttcacggtgaacattgcgctgatcgaaaacggcaagccggtgctcggcgtggtctacgcgccggtgcttaacgtgatgtacagcgccgccgacggcaaagcctggaaagaagagagcggcatccgcaagccaattcaggtgcgcgatgcccgtccgccgctggtggtgatcagccgctcgcacagtgatgatgagctgaaagagtacctgcaacagctgggcgagcaccagactacttccattggctcgtcgttgaaattctgcctggtggcagaagggcaggcgcagctttatccgcgctttgggccgaccaacgtctgggatacggcggcgggccatgcggttgccgccgccgccggggcgcacgttcacgactggcagggtaaacccctcgactatacgccgcgtgaatccttcctcaaccccggcttccgggtttctatttactgagtaactggcgcagcagggcgactacctgctgcgcttcttctggcgtcagcgcgccatctttcgcccactggacccgtccgtctttatccagcaccgccaccgcagagctttcttcatccagttgccaggctttacgcgccaccccgtcgctgtcgacgataaactgtgaccagggatagagctttttattgctctcaatgctgctgcgcacaaacatcgccgaaccgggaatggcatcatcggtattaatgatggtggtggtctggtaacggtcgtggggcaaattcgctgatttgatcgcttcgatcagcgcggcatttttctcttttgctgacgaacgaccggcaatatgttgcaccacccgcacttttccaggcagctgcgcgctgttccattttttgtagctaaactcattattactgaggatcagctcccctctgtcggcgatgccgaccggcggaacgcgctgattgttctcaaagcgatgggcagaggccatcaatggcaggagcaggcaggtggctgccagcagggtgcgtagggtcatgaggtttccttctgtattattgtttgcaggtgatccgaccacttggtcttaacatttttaatcataagtgcgatcaagggtgttttcccgcaatcccggtgccactttgcggcgtaacgcacacatctgtaaaaaaacgacgacttatactgcctctgattaagcatggaaaagaatattctgattaattgtcatgaaacggtaaataacctgctgcaaactgggtaacaggtggtttgtgatctatagtcattgggcaacaaaatttgcgttcataacagtcggtccgattgtggtaccgcaagggcgtagactcagcagaagagagacaacaatgaaaattttccaacgttacaacccgcttcaggtagcaaaatacgtaaaaatcctgtttcgtggacggttgtacatcaaggacgtcggggctttcgagtttgataagggtaagatcctgctgccgaaagtaaaagacaaacagcattactccgtaatgtctgaagttaaccgccaggtactgcgtttgcagtctgatttggcgtaatcgatgtgctatgcagtcgtttaaataacgaaaatgcaaacggcccctgaaggggccgttgatgtttctggctcaggtaaaagttacgccgcgcctttctcactgccatccggcattttcggcaccagcaccgttggcttgctgtcgatacgcgtcaccagcagctgatcgatgcggaagttatcaatatccaccacttcgaacttaaagccgttgaatttcaccgagtcggtgcgtttcgggattttacgcagcatgaacatcataaaaccgccgatggtttcatagttgccggactgcgggaactcgtcgatatccagtacgcgcatcacgtcgtcaatcggcgtaccgccgtcaatcagccatgagttttcatcgcgcgccacgatctgctcttcctgaccctggcccaccagatcgcccatcagcgtggtcatcacatcgttcagcgtgataatgcccaccaccagcgcgtattcattcatgatcaccgcgaagtcttcacccgccgctttgaaactttccagcgcttccgaaagcgtcagcgtatccggcacgatcagggtgttgcggatctgcacgccgttcaccagcgtcaggctctggttgccaattacacggttcagcagatccttggaatccacatagccgatgatatggtcaatatcttcattacagacgaggaatttggagtgcggatgctgcgccactttattcttcaggctctgctcatcttcatgcaaatcgaaccagatgatgttctcgcgcgaggtcattgacgacggcacggtacgggattccagttcaaaaacgttctcgataagctcgtgctcctgcttacgcagtacgcccgccagcgcgcccgcttccaccaccgcataaatatcgtcggaggtgatgtcgtctttgcgcaccatcggcagtttgaaaatgcggaaaatcacgtttgccaggccattaaagaaccacaccagtggggtgaagataaacaggcagaagcgcatcgggttgatgatgcgcaaagccaccgcttctggcgcaatcataccgatgcgtttcggagtgagatccgcaaacaggatgaacatactggtaacaagggtgaaggagatcataaagctcagctgatccgccagctccggtgacatgaagttgatcagcacgctgtagaaggccggggagaatgccgcatcgcccacgataccgccgagaatggcgaccgcgttaaggccgatttgcaccaccgtaaagaacatacccggcgtttcctgcattttcaggatgcgcatggcattgatattgccctcatcggccagcagcttaagtttaattttacgggacgccgcgagcgaaatctccgacagcgagaaaaacgcactcacagcgatcagacagagtattagtaaaatactgtttaacatatcttatccagccataggccagatcctcgaaagggggaaggttgaaaatctatgtggtaaagctaagtaaaagcgggccgtggaaggttgacccgcaatttcagggggtagtatagcctaaggcagcgttgggttgccagaacgggcttggtcagtaatacaccgccttcattgcgccaggcttatccattgccggatctgcgaggagcggtagatcgcctcgactatcgcctgcgcgcaggcggcatcctcaagggagatatgcacaggccgtgtgggatcgcgcacggtggcataaaactgctggatcgcccgccggtggccatcgccccagtagtttctggcttcgccgtctggcggggtatcctgcgccagcagcgtgcgaacattgtcggtaatgcgccagagctgattttcctccagccgtaagcgtccccgttcgccgtcaatttcaagggaaagcgcggcatctgctgagtagcaggtggtggcatggaacacgccatacgccccgccgctaaattccagcgtcgccatcgcgctgtcttctgtctcgatcaccccgcttaataaggtgctgtcgaccacgccttttacccgcgtcacgccgcccgcgaaccactgcatcagatcgagggtgtgaatcgcctgattgatcagcaggctgccgccctcggtggcaaagcgtccgcgccagccgccaggcctgtagtaatcaccgccgcgcgaccacgtcaggctggccttcatgccccgcagctggccgatgccgccatccgccagctgcgcccggatcgcctggctggtggggttatagcgattctgaaagcacaggccgagcacgcccttagcaccggcagccgcttcccggatctgcgccacctctgccagcgacaggccgaccggcttttcgctgaacacctgctttccggcggcaagcgccgcgatgatcatctcccggtgcagatggtgcggggtacagatatgcaccgcgtcgatgttcatgtccgtgagcatctcgcgataatcctgataaaaacggcagccgtagcggcgggccagcgccgcgcctttttccgcgtcgatgtccaccagcgcgtgcaggctcaccccgggcgtatgttgcagcgccgccacgtggcagccatggatcgcccccgcgccaatgatggcgacgttaagcctgtccatttacgcctccggctgacgggcgtttgccagcatttgcgcccgcacgcacagctctgccgctttgaacgcgtgagcctgggtcatggcgttttcggtgcggtgcagacagtcgagtatcagcgcgccaaaataggggaagccaatttttccggcgacgggataacggaattcgcccgcctgattcaccagatagaccacgtcctgctcgccgcgcgacaggtcgatgtatttgcggatctcgatataaccttcggtgccgagcagcgtcaggcggccgtcgccccaggtggacagcccgtccggcgtgaaccagtcacagcggaaatagccgctcgcgccgttctcccccgccagcatggcatcgccaaaatcttcaaaggtgggatactgcggatggttaacattgcgcacctggcttgccaggatgcgcgcgtcctggttgccggtataaaacagaaactgttcgatctgatggctgccgatgtcgcagagaataccgccataatagcggcgatcgtagaaccagtccgggcggccgtggccttcgcggtgcggcccagtgccgagcgtctggatcacccgaccaatcgccccctgcgccaccagttgtccggcaaagaccgcgctttccacatgcagccgctcgctgtagtagaccgcgtatttgcgcccggttttcgccaccatcgccttcgcgtccgccagctgttccaggctgataagcggcgctttgtcggtgaaataatcttttccggcggccattaccttaagccccagcgggcagcgttccgacggaaccgccgctgccgccaccagcttcaccccgggatcgcgcagaataacctccagcgaggcggccgcctgcgcctgcggatactgttcgaggaatttttccaccctggccgcgtccgcatcataaacccatttcagggtcgcgcccgcctccgtcagaccgttgcacataccgtaaatatgcccgtgatcgagcgccacggcggcaaaaacaaattccccgctgcccactaccggctgcggtttgcccgtcggggcataatgcattccatcctgtttgttcatctttgtgtcctttggcaatcaccaggtaccggaagcgtccagggtgcggttttcaacgtttttctctgccgattgcgcgatgcgctcctgtaacagttgcagatagcgcgcttcgtccagcggcagttcaacccagtcgtccgtccaggtggagaggtgcatggcgttagagagcgtcaggccgtggatgccttcgcagcctggcgcgatcagcggctcgccgcgcagaatagcggcggtgaagttggcggtaataacctgatgatcgctgcacggcgcggcgacggggagggtgacttgccagcattccggctcgccaaaaccgtgctgccagcgggcattgaagtccggttcggattcgcgcagacgccagaagcgtaaagcgccgtcttccaccacaactttgccgcgatcgcctgcgatctccaggcgattagtccccggcgtttcggcgacgctggtaataaacacgcccgttgcgccgttggcgtattcggcgtaggcggtgacctcatcttccacttcaatctgccggcgcttgccgaagtgacagaacgcccgcaggcgtaccggcatgcccaccagccactgccagagatcgagctgatgcggatcctgattcagcagcacgccgccgccttcacctttccacgtcgcccgccagccgccggagttgtagtaactctgcgagcgataccagttggtgatgatccaggtcgagcggcgaatttctcccagctcgccgctgacaatcaggtccttcactttctgataaagcggcgtcgggcgctggttgtacatgatgccgaacaccacatcgcactcgcgcgcgcaggcgttcatctcccgcacctgagcggtgtagacgcccgccggtttctcgcacagcgtatggataccctggcgcatcgccagcatcgacagccggggatgatcgtagtgcggcgtggcgacgatcaccgcgtcgataagcccgctttgcagcatcgcccgggcgtcatcaaacagcggcacggcctcgcccaccagcgcgcgtatcgccgcatgtttcgcagaattattatcgcagacggcggcaaggcaggcgtcgccgatttttccggccagcagatagcgggcgtgcaccgtgccgatattgccgatgccgataatgccaaaacgaacctttttcattgctcacctttggggatcagtgggaataacgggaaaatagagacgcggcaaaccggcgacaaacacaatttgtgagaatgctcgcagggaggcgaggaaactgcgcggcactctgaaaaagggttttaaaatcatcatactggcgctgcaaaaatttgcaggtattgattgcgagcaggatcacactatggcaggaaagctgaaaatggacgccattgccgcacagacgggctactccgtcagcaccgtctcgcgggtattaagcggcaaagccgccaccagcgcgaaagcgcgtgagacgattgtcagctgcgcgcggcggcttggcgtgctcgatgcgctggcatgcggccgtctgctgatcaacgacattgccgtcttcgccccggcacgcactttcagcatgggtggcgatcccttttatcatgcggtgacgcgcggtattgccggggccaccgccgcccatgatgttcacctgagctattgcagcctggaggagcaggacgccgatctggcgcgctttctggcaaaagcgggccacaaaaatatcagcgcgctgatcattatcggcatcgacgatccggcggttcaccggctggcgcagacgctcggtaaaccctgtgtgctgatcaacgccagtaaccgtgaaagccgcctcgacgcggtgtcgccggatcaccgcgccatcggttttaacgccgcgcggcatctgctggcccacgggcaccggcgcattctcaccatcaccaccctgcggcgcgaaaccctgtctgtgcggctggaaggcatcctggaggcgtaccgtcattttcatgtggcctttgaggcggcaacggatctgctggtgacggaaggctttggcggcgacgaggccgcccaacggctggcgcagtggttcgacgcccggcctgcggatcagtggccgcaggcgctgctgtgcggcagcgccgatatgacggcgggtattcagcggatgctggcgcagcgcgggctgcgggtaccgcaggatgtgtcgcttatcagcacggatgtggaagggcaactggacggcagcgtgaccggtattgcggtgccctgccgtgagctgggcgtggaggcggtgcatatgttacagacgcggcttaaccgcccgcaggccccggtgtttaatctgctgctaccggggcggctggtggagttcgggacggtcagccaggcgacccgccatgcagcgcaggccttcccctcaccctaaccctctccccagggagagggactggctcgttctcgatctcccgtcaggagaggggactggctcgttctcgatctcccgccaggagaggggactggctcgatctccctctcccgccgggagagggccggggtgaggggagacgattacgccgtgccctgcggtggcagacagacgccgataccaccgataccgcagtagccgtacgggtttttatgcagatactgctgatggtcatcttccgcatagtaaaacggcccggcggtcttgatttcggtggtgaccgtacggtcatcccccgctgcgcgcatggcggcctggaaacgctcaaggctggctttcgccgcggcgtcctgttccggcgtcagggggtaaatcgccgagcggtactgggtgccgtggtcattgccctgacgcatcccctgagcgggatcgtgattttcccagaacacctgcaacagctgttcatagctgataacgttcggatcgtagaccacgcgcacggcttcggcatggccggtctgaccgctgcacacttcgcggtaggtcgggttcggcgtgtaaccgcccatatagcctgcggcggtgctgtaaacgccgggtaaaacccagaacaaacgttcaacgccccagaagcagcccatggcgaaaaatgcgacgtccatcccgtccgggacatgcgtcatcgagtgttcattgaccgcatgcagactggcaaccggcatcggcgtgttacggcccggcagtgcatccgactgagtaacaaggtgttttttatcaaatagactcacggtgtggcctccggggaaagggaattgtggttagggttgtaacggcgctcgtcttttaacacaataagtgctttaaatacggctaaatttaaacataagaaatattgaggttgtcgtctgtttttcaacccgcattgttgaattattgttaagccgggagcggcattttggtttccttccagggccaggacaaggatattcaggagagaacgtgccacagatccgtcttataggtattgccactttactgctggcaagcggtcacgcctttgcggcaaacgtccgtttgcaggtagaggggttatcaggcgcgctacaaaaaaacgtccgcgcacagctgtcgacgattgaaagcgatgaggtcacccccgatcgccgctttcgcgctcgcgtggatgacgccatccgtgacggtctgaaagcgcttggctactacgagccgaccattgaatttgatctgcgcccgccgccggccaaaggccgccaggtgctgatcgcccgcgtatcgccgggcgaaccggtgcgtatcggcggtacggatgtgatcctgcgcggcggcgcccgcaccgatcatgactatctcgacctgctgaaaacccgtccggctaccggcaccgtactgaatcatcacgattacgacagctttaaaaaatccctcaccaacgttgccctgcgcaaaggctatttcgacagcaagtttaataaaagccagctgggcgtcgccctcgatcgccatcaggcgttctgggatattgattacgacagcggcacgcgctaccgctttggtgaagtgactttcgaaggctcgcaaattcgcgatgagtacctgcaaaatctggtgccctttaaggagggcgattactaccagaccaaagacctggcagagctgaaccggcgtctgtccgccaccggctggtttaactcggtgatcgtcgcgccggaatttgaaaagtcgcgcaaaaccaaagtgctgccgctgcatggcgtggtatcgccgcgaacggaaaacaccattgaaaccggcgtgggttactccaccgacgtcgggccgcgggtgaaggcgtcgtggaaaaagccgtggatgaactcttacggccacagcctgatcaccaacgccagtatttccgccccggaacagcaactggatttcagctacaaagtaccgctgctgaaaaatccgctggagcagtattacctggtgcagggcggccttaagcgcaccgatctgaacgatacggaagcggattccaccacgctggcggtgtcccgctactgggatctctccagcggctggcagcgcgccattaacctgcgctggagtctcgatcactttacccagggcaacgttaccaacactaccatgctgctctatccgggcgtgatgatcagccgtacccgctcgcgcggcggcctgatgccgacctggggcgactcccagcgctactccattgattactccaacaccgcatggggctcggacgtcgatttctcggtgttgcaggcgcagaacgtctggatccgtacccttgccgatcgccatcgctttgtggcgcgcggcaacctcggctggatcgagaccggcgatttcgacaaagtgccgccggatctgcgcttcttcgccgggggcgatcgcagcatccgcggttataaatacaaatccatttcgccgaaggatgacgacggcaagctgaaaggggcgtcgaaactggcgaccggctcgctggagtaccagtacaacgtcaccgggaaatggtggggcgcgaccttcatcgacagcggcgaagcggtgagcgacattcgccgcagcgatttcaaaaccggcgcgggcgtcggcgtacgctggcagtcgccggtcggccccattaagctcgatctcgccgtgcccatcggcgacaaagacgaacacggattacagttttacatcggtctggggcctgaattatgagtttgtggaagaaaataagcctcggcgtactgatcttcatcctgctgctgctgggcaccgtcgcctttctggtgggcaccactaccggcctgcatacgctgtttaaagcggcgaatcgctgggtgccagggctggaaattggccaggtcaccggcggctggcgcgatctgcatctgaaaaatcttagctacacccagcctggcgtggcggttaacgccggggatattcatctggcggtaaagctcggctgcctgcgtgacttcagcctgtgcgttaacgatctgtcgctgaaagacatcaacgtggcgatagacagcaagaaaatgccgaagtcggaacaggtggaagaagaggataccggcccgctggatctctccacgccttacgccatcaccttaagccgcgtggcgctcaataacatcaacattaaaatcgacgacaccaccgtgtcggtgatcgaattcaccagcgggctgaactggcaggagaaaaacctgacgctgaagccaacgaatttgcagggcctgctgatcgcgctgccgaaagtggcggaggtggcgcaggaagaagtggtggatccgaagatcaataaccctcacccggacgaaaagccgctgggtgaaaccctgaaagatctgttctcaaagccggtgctaccggagatgaccgatgtgcacctgccgctgaatctcaatatcgaggagtttcgcggcgaatccctgcgtctgaccggcgataccgatattctggtgcgcaccatgctgctgaaagtcagcacgcaggacggcaacatggcgcttgatgcgctggatatcgactcgaaccagggcacggtgaacgccaccggtacggcgcagctcagcaataactggccggtggatctgacgctgaacagcacgctgaacgtcgatccgctgaaaggcgaaaaagtgaagctcaaggtcggcggcgcgctgcgtgaaaccctcgatgtcggcatcaatctttccggtccggtggatatggtactgcgcgcgcaaactcagctcgccgaagcgggtctgcccctgaatctggaagtggtgagcgaacagctgtactggccctttaccggcgagcggcagtatcaggccgacgatctgaagctgaagctcagcggcaaaatgaccgattacaccctgtcgttccgcacggcggtcaaagggcagagcgtaccgcccgccaccatcctgctggatgcgaagggcaatgagcagcagatcaatctcgacaagctgaccgtcgcggcgctggaggggaaaaccgagctgaaagcgctgctcgactggcagcaggcgatcagctggcgcggcgatctgacgctcaacggcatcaataccgccaaagaattcccggactggccgtcaaaactgaacggcgcgatcaaaacccgcggtagcctgtacggcggcagctggcagatggatgtcccgcagctgaagatcaccggcaacgttaaacaaaacaaagtgaatgtggaaggctccctgaaagggaacagctatctgcaatgggtgatcccaggtctgcatctgcaactggggccgaacagcgccgacgtcaaaggcgagctgggcgttaaagatcttaaccttgatgcggtgataaacgcgccggggctggataacgcgctgccgggtctgggcggcacggcgaaaggcctggtgaaagtgcgcggcaccgtcgatgcgccgcaggtgctggcggatattaccgcccgtgcgctgcgctggcaggagctgtcggtcgccagcgtgcgtgtggatggcgatgtgaaatccaccgatcagatcgccggtcacctcaacgtgcgcgccgagcgcattgcgcagccgggcgttaacctgagcctggtacagctggatgcaaaaggcagcgaaaaacagcacgagctgcaactgcgtgtgcagggcgagccggtatccggccagcttaaactggcgggcagctttgaccgcgccacccagcgctggaaaggcaatctgagcgacacccgcttcgccaccccggtcggcccctggtccctcaaccgggcgattgcgctggattaccgtaacagcgagcagaagatcagcatcgggccgcactgctggactaacccgaatgcagaactgtgcgtaccgcaaactatcgatgccggggccgaagggcgcgcggtggtgaaccttaaccgcttcgatctggcgatggtaaaaccctttatgccggacgccacccaggccagcggcattttcagcggcaaagccgacgtcagctgggatacaacgaaagagggcctgccgcagggggaagtgaccctctccgggcgcaacgtgcgcgtgacgcaaaccatcaacgacgcgccgctgctggtggccttcgacacgcttaaccttaacgcgcggctgcgggataaccgcgccgatctcggctggatgatgcggctgaccaataacggtcagtttgatggccaggtgcagatcaccgatccgcaggggcggcgtaatctgggcggcaacgttaatatccgcaacttctctatcggcatggtcaacgccatcttctcgcgcggcgaaaaagcggcgggcacgctgagcgccaacctgcgtctggccggggatgcgcaaagcccgcagctcttcgggcagatgcagctgaacggcgtggatatcgacggcaactttatgccgttcgacatgcagccgagccagctggcgatgaacttcaacggccagcgctccacattgcagggcgtcgtgcgcacccagcaggggcagatcaacctcagcggcgatgcggactggagccagctggataactggcgcgcgcgggttgccgccaaaggcagcaaagtacgcatcaccgtaccgccgatgatccgcctggatgcctcgccggacgtggtgtttgtcgccacgccggatctgttcaccctcgacggcagcattgatattccgtgggcgcgcatcgtggtgcacgacgtgccggagagcgcggtcggcgtatccagcgacgaagtgatgctcaatgccaacctggagccggagaaaccgcagtccgccagcatcccgatcaacagtaacctgatcgtgcatgtgggcaataacgtgcgtatggacgcctttggcctgaaagcgcgtctgaacggcgatttaaaagttgcgcaggataatcaagggcttggcctgaacgggcaaataaatatccctgaaggacgcttccatgcctacggtcaggatttgattgtgcgcaaaggtgagttattgttctcgggcccaccggatcaacctttacttaacattgaagcgatccgtaaccccgaggccaccgaaaacgacgttatcgcaggcgtacgggtgacaggtaccgccgatgaacctaaggcggagatcttctccgacccggcgatgtcgcagcaggaagcgctctcctatttactacgcggacagccgctcgacagcgatcagagcgacagcgcggcgatgacctcggcccttgttggcctgggggttgcacaaagtgggcaggttgtgggtaaaatcggcgagacgttcggcgtcagcaatctggcactggatactgccggggtgggggactcctcccaggtggtggtcagcggctatgtactgccgggtctgcaggtgaagtatggagtgggtatttttgattctctggcaacgctcacgctgcgctatcgcctgatgcctaagctttatctcgaagcggtgtctggcatagatcaggcacttgatttgctctatcagtttgagttttagcaatgcgaatatttgtctacggcagtttacgacgcaagcaaggcaacagccactggatgaccaacgctcagtggctgggcgatcataatgttgaagattttcgactgtacagtctgggtcactaccctggcgcggtgcccggtgcgggccatgtgcagggggaagtctatcgtatcgattcggcgacccttgccgaactggatgcattacgcaccgcaggcggtgagtataaacgtcagttgatccagacaccgtacggcagtgcatggatgtacgtgtaccagcgtccggtcgacgggcgcacctggattgaaacgggaaactggctggatcgggaccggtattaatacaacgccaccttcgggtggcgttgttttttgtggattgactaaggcgcaggggtgattttcagctccaccagccctatccccagcctgcgctgaagagtttctgccagcgtgacgccacggccttcctcatcaacaggctcgctgtcgggcggcgtgatgatcagttcagtcggaccgccggtcgcggaaaagcgtaccgttcgggtggaaatttcactaccaaataccaggctatgttcttcttgtccggcgcgcacaagaatctttttcccgatgttagcggcagaggctttggctaccagggtaaggtcaaaggcgtccggcaagggacgtttataaaccacggttaccgccgggtcgatattggcattcgaccagcgtccccagtcctcctgccacgaaatcccccgcaccgccttcacctgttgggggaacccttcaatgtcgaacatgatgcgatccgccggataacgcacactgtctggcgtctgattaaggcttttcacccgctgatgaatgtccacgcgatcatcgtcgtgctgcggaaatgccactctggtctgataaaccggcgtcgggattctccgcacgctcaccgccgactccagcgtgccttccgctaagcagagttcccgtgcggtcgccagctcaggcttccccaggcgggcaatgcgaaagcacttatcgatccacacaaagcgatcctctgccccgaaatgggcaaggtatttactcagcggcgcgttataggtgcccggaagatagggctgcacgctgtcttccgttaccttgaagagcaccggcagggtgtagttaaaatcgcccagcgacaggctgccgctctgctgattaatcactaactggtcaatcttttgcggatcgcccgaccataaacgaataatatccggctcccagtccagcagacgcgtttcaagggatgtataggtggcggacagggagggacgtgaaagggtactgcggccaagcccgatggcgttatcgccgccgagtaattccagcacggtggccccgttatccatcgtattacgtggccgggaaataaccttcgtctgtgaacgatcgccgcgcagaataaaaaacaaattttcccgctgcggttgtttttgcgcaatctgaccgccgatgggctccatcgccagatgatcggaggacaccacgatcagcgtatttttaaagccaggcgacgctttgatcttattaatcagcgtggcgatattttcctggctgcacagcacggcgttgaacgcctcgtctttgccctcctgccagcgtttttgctgacagcttttcgcaatggatcccaccggcggatgcgtatccacggttaaagcaaagagcgcgaaaggcttattttgcgcggtaagcgtctggtatttctcccagaccgcattaagagtggtgtcatcgtgcagaccccagtcattgaggtacgtcttatccggcagcgcgtctttttgctcctgcaatccgtcgacatgctgaaagccatgcgtgttaaaaaacgccgctttactggcaaaacgcagatccgcgccctgataaaagtaattgtcataacctgagtttttaagaatatcgccaagacatatcagcgagggaaaaaaactgcgcaggttatcagagaaattacgatccataggggagaagaagggaataccgcactgcgaggcgacaataccgccaatggtaaaatctgtccccggtaattgcctggtgtcagaaaaatctaatgaagattttctgataagatttaaatcgggaaccagccgtgggaatttattttcgtcaaacaaggtccgctcaagactttccgcataaatatacaccaggttataagcgggattatttatcttcgtggctggtttaattaaatattcaggaaagtcagaattagctttacggtaccgggaataagcaatatccgcaagctggccggtggcaggcatcaggctgattgccgccactattaatagcatcgccacacacatcaggcctttgtgcccggcatgaccggtggcgcgcataaacaaccagcccagtaacagcatactgacgatcatacaggcggccagtcctgcggcgggtaacagatactgggcgatcccggcgccggtcaggttatccgtcagcgtataaacggcggcgcggttaatgccggcgccggtaaaataattacagccgaaatataaaatattaagcagcagataaatgagcgaaccgaccatcgttgcccgacgccagcctttttgctgtcctgcggtgcgcaggaagaggatcagccctgtaaaaaacaggacgaaatgcaaataactgttcaaagccaactccatttagctcagattatccccaaaatccgggatacagcaatactgatatatttagttaatgaataaaaaaacggaccctgctgttggcgggtccgttgatagtaatactttaaataaacccgctatacggaattatttcttcgctgcgcgctcgaaagaggccacgatttcagctttagccgcttcggcgttgtcccagccgtccactttcacccatttgcctttttcgagatctttgtagtgctcgaagaagtgagtgatctgcgctttcagcagttccggcaggtcgttcacatctttgatgtgatcgtattctttgctcagtttagtgtgcggaaccgcaaccagcttggcgtcttcgcccgcttcgtcggtcattttcagcacgccaaccggacggcagcgtacaacagagcctggctgtaacgggtacggcgtcggtaccagcacgtctaccgggtcgccgtccagagacagggtgttgttgatgtagccgtagttgcacggatagaacattgcagtcgacatgaagcggtcaacaaaaagcgcgccggtgtctttgtcgatttcgtatttgatcggatcggcattggccgggatctcgataacaacgtagatgtcttctggcagatctttgccggcaggtacgttcaataagctcatgtttgtttcctttaaaatgtgtgcaaacaagtgccgggtattatagctaactccctgggaaagtctctggctgttttcagccgtgtcgtctgttgataacggattcaggagcaatctgacgcgcggattgtccataaagttagctgcatactgaataaatttgtggaagcgtttacacagcgcgatttgcgacaccgtaaaacgcaaaaattccgcaaatgccaggtatgtcataggtctgttaaaacatcacttttcgcgcgctggatctcatctggttgttaacctttcgttcacttttctgaagtgtgatgtaacgcattctgttacatctctggttgtctatagtgtccgggcaggtgaagttatagccaacaataaccctacgaggatgtccctatgtggaagcgcttacttcttgtcacagcagtttcggcagccatgtcgtctatggcgatggccgcacccttaaccgtcggtttttcgcaggtcggatctgaatccggctggcgcgccgcagaaaccagcgttgcgaaaagcgaagcggaaaagcgtggaattaccctgaaaattgccgatggtcagcaaaaacaggagaaccagatcaaagccgttcgttcctttattgcccagggcgtggatgcgatctttatcgcgcctgtggtggcgacaggctgggagccggtcctgaaagaagcgaaagaggcggagatcccggtcttcctgcttgaccgtaatattgatgtgaaagataagtcgctctacatgaccacagtgaccgccgacaacgtactggaaggccgcttgatcggcgaatggctggcgaaaaccgtcggcgacaaacagtgtaacgtcgtggagttgcagggcaccgttggcgcaagcgtagccatcgaccgtaagaaaggtttcgccgaggcgatcagcaaaacgtcgaatatcaaaatcatccgttcccagtccggcgacttcacccgcagtaaagggaaagaggtcatggaaagcttcatcaaggcggaaaacaacggcaaaaatatctgcatggtttacgcccataacgacgacatggcgatcggcgcgatccaggcgatcaaagaagcgggcctcaaaccgggcaaagacattctgaccggctccatcgacggcgtgccggatatttataaagcgatgatcgacggcgaagccaacgccagcgttgagctgacgccgaacatggccggcccggccttcgatgcgctggaaaaattcaaaaaagacggcacgcagccggaaaaagtcaccatcaccaaatcgacgctctacctgccggataccgcgaaagaagagttagagaagaagaaaaacatgggctactaagcctttaacctgccgggtgacgctgcgcttactgacctgagacgtgcttttacaggccggtaagcgtagcgccatccggtttgacgcagggggaaccatgaccacagaacaacaccaggaaatcctccggacagagggcttaagcaaattcttccccggcgtgaaggcgctggataacgtcgatttcagcctcaggcgcggcgaaatcatggcgctgctcggtgaaaacggcgcgggaaaatcgacgctgattaaggcgctgaccggggtctatcacgccgatcgcggcgctatttatctggaaggcgaacgcatcgcgcccaaaaataccgcccatgcccagcaactggggatcggcaccgtttatcaggaagtgaacctgctgccgaacatgtcggtggcggataacctgtttattggccgcgaaccccggcgattcggttttttgcgccgtaaagagatggaaaaacgcgccaccgcactgatggagtcctacggcttctccctcgacgtgcgtgaaccgctgaaccggttttccgtggcgatgcagcagatcgtcgccatttgccgcgccatcgatctctcggcaaaagtgctgatccttgatgaacctaccgccagcctggatacccaggaagtggagatgctgtttaccctgatgcgtcagttgcgcgaccagggcgtgagcctggtttttgtcactcactttctcgatcaggtgtatgaggtcagcgaccgcatcaccgtactgcgcaacggcagctttgtcggctgcaaagaaacgcgcgagctgccgcaaatcgagctggtcaaaatgatgcttggccgcgagctggataacaacgcgctgcaacgcgccgggcgcacgctgctcagcgacagaccggtcgccgcattcaaagactttggtaaaaaaggcgttattgctcccttcgatctggaggttcgcccgggtgagatcgttggcctggcgggactgttaggctccggacgcaccgaaaccgccgaggtgatcttcggtatcaaacccgccgatcagggcaccgcgctgatcaagggcaaaccgcaaacgctgcgctcgccgcatcaggcttcctgcctcggcatcggtttttgccctgaagaccgcaaaaccgacggcattatcgccgccgcctcggtgcgggagaatatcattctggcgctacaggcccagcgcggctggctgcggccgatcccgcgcaaagagcagaacgagatcgcggcgcgctttattcgccagctggggatccgcacaccgagtgcagagcagccgattgaatttctctccggcggcaatcagcaaaaagtgctgctctcccgctggctgctgacgcggccgcagttcctcatcctcgacgaaccgacgcgcggcattgacgtgggggcccacgccgagatcatccgccttatcgaaaccctctgcgccgacggcctggcgctgctggtcatctcctccgaactggaagaactggtcggctatgccgatcgggtgatcatcatgcgcgatcgcaaacagatcgcggagatcccgctggcggaacttaccgtgccggcgatcatgaacgccattgcggcctaaggagaagcatgtgatgcctcaatctctgccccgcgcgggggaacctaaacgccgcttcagctggccggtggggacgccgcaaattattgcgctgttactggtgctggtggtcgacagcctggtcgcgccgcacttttatcaggtgattttgcaggatggccgcctgttcggcagcccgatcgacattcttaaccgcgccgcgcccgttgcgctgctggcgattggtatgacgctggtgatcgccaccggcggcatcgatctttccgtcggcgcggtgatggccatcgctggcgcgacggcggcctcaatgaccgtcgccggacacagcctgccggtggtgatactggctgcgctgggatccggcgtgctggcgggattgtggaatggcgtgctggtggcaatcttaaagatccagccctttgtcgccacgctgatcctgatggtcgccggacgcggcgtggcgcagctcatcacctccgggcagatcgtcacttttgacgcgcccagcctgtcgtggcttggcagcggctcgctgctgctgtttccgacgccggtgatgattgcgctgttaacgcttatcctgttctggctgttcacccgtaaaacggcgctcggcatgtttatcgaagcggtggggatcaacatccgcgcggcgaaaaacgctggcgtgaatacccgtatggtggtgatgctgacctacgtgctgagcggcctgtgcgcggccattgccggtattatcgtcaccgccgatattcgcggggccgatgcgaataacgccgggctgtggctggagctggacgctattctggcggtagtgatcggcggcgcgtcgctgatgggcggacgctttaatctgctgctgtcggtggtgggggcgctgatcatccaggggatgaataccggcatcctgctctccggcttcccggctgaactcaaccaggtggtgaaagccgtcgtggtgctgtgcgtgctgattgtccagtcgccgcgctttatttccttcattaaacggagccgtggtcatgatcaaacgtaacttaccgctgatgatcacgcttggcgtgttcgtgctcggctatctgtattgcctgacgcaatttcccggctttgcctccacgcgggtgatctgcaacatcctgacggataacgcctttctcggcattatcgccgtcggcatgacctttgtgatcctctccggcggtatcgatctgtcggtcggttcggtgatcgcctttaccggcgtcttccttgccaaagcgatcggcttctggggcatctcgccgctggtggccttcccgctggtgctggcgatgggctgcgcctttggcgcttttatggggcttttaatcgacgggcttaaaatcccggcctttattatcaccctggcgggaatgttctttctgcgcggcgtcagctatctggtgtctgaagaatccattcccattaaccacccggtgtacgacacgctttcaagcctggcgtggaaaatccccggcggcgggcggctcagcgccatggggctgctgatgctcggcgtggtggtgatcggcattttcctcgcgcaccgcacgcgctttggcaatcaggtgtacgccatcggcggcagcgccacctcggcgaatctgatgggggtgtccacgcgcagtaccactattcgtatttatatgctctctaccggtcttgcaaccctcgcaggtattgtcttctcggtttacacccaggcaggctatgcgctggcaggggtcggcgtggagctggacgccatcgcgtcggtggtgattggcggcacgctgttaagcggcggcgtcggcacggtactggggacgctgttcggcgtggccattcaggggctgatccagacctatatcaactttgacggcacgctcagctcctggtggacgaagatcgccatcggcatcctgctgtttatttttatcgcgttacagcgcggcctgaccgtcctttgggagaatcgccagagctcgccggtaacacgtatcagcacggcggcaacaaagccataacgcactgaattggttaaaaaacgttaaagattttccggtggcagccgataactcaaaattacgctctgtttgcgccacgaagtatccctgctaccggaatcatcatcatgctaaaaacgctatcgattcgcaccggcttgctgtctttactggccgttatgacattactcctgctgctggtcagcggcatcgggatttacgccctcacgcaaagttcctcctctctgcaacgcatcaatcaccttcagggtgagcagatggcgcgtctgaatgaaggatataacctgattttacgcgcccgcaacgaggccggtcaggctgtacgcatgatggaagtcgggctgctggacgatgccgggaaatccgtcaaagggatcaacagcgaaatcgcgcaggcgcagaaaggcctgcaggcggtaatcgatgcgggcgtggatgacgaagccggtaaaccgctgctggatcgtctggcgaaaagctatgccgactacaatagccagggcatcgtgccgatgcagaaagcgctgaacgagcaaagccccgacggctattacgatctgctggaaaacaagctgattccggtgtcgcgtcagtttgataacgacatgcaggcattcctgaaatggggcgaaacccgcggtcaggcggaagtgaaggcggtgcaaagcagtaaaaaccgcgtcatggtgtttatcgtcattgccgcgctgttgacggcgggcgtcatcgtgctggcgtggctggtgctgcgtcatatgctgttaaaaccgctggatgcgtcaatccgtcaactggagcaggtggccgcaggcgatctcacgccggtcagcgccgcgcccgccagcaaggagttcaaccgcctgatcgccgccattgatgagatgcgccattccctggtgggatcggtcacccgcgtgcgcgatgccagcgcgcaaattgataccggcagccgcgagctgaccgccggcaatatggatctggcgcagcgcaccgaatccaccgccagctcccttgagcagacggcggcgagcatggaagagatcaccgccacggtgaaacaaaacgcggacaacgccgaacaggcgcaccagctggcgaaaaccgtctcggataccgccgatcgcggcagcgaaatggtctgctacgtgattgaaaaaatgagcgatatcgccggcagtgccaaccgtatcgccgacatcctcagcgtcattgacggcattgccttccagaccaatatccttgcgctgaacgcctcggtggaagccgcgcgggcaggggagcaggggcgcggttttgcggtggtcgccgcagaagtgcgtaatcttgccggtcgcagcgccgatgccgcgaaagagatccgcaccctgatcagcgattccaaagcgcacgtcagcgaaggcaacgatctggcgatccaggccggggaaaccatggatgaaatcgccggtgaagtgatgcgtatgaccaaactgctgcgtgaaatcgccagcgcctcgcacgagcagagccgcgggattgaacaggtgaatattgcggtcaatcagatggacgagacggcgcagcagaactccgcgctggtgcagcaatcctccgccgcgacccgctcgctggaagagcagtcgcgtgaactgatggaagcgatggcatcgttcagattgcagatggcgggctaagaggctgaattgcccggcacactaatgagtaggccgggtaagcgtcagcgccacccggcgaaccgtatcaacaatctaaaaattacgcgtccggatactcacgcataaagcgctctacgtcattcaccatatgctcgttgccgacgaagaacgggcggcgctggtgcaggctttccggcacgatgtccagaatacgctctttaccgtcgctcgctttaccgccagcctgctctgccaggaacgccatcgggttaccttcatacagcagacgcagcttcccttccgggtggcttgcggtgctcgggtaaaggtagatgccgcctttcagcaggttacggtggaaatccgccaccagcgaaccgatatagcgcgaggtatacgggcgatgggtggcctgatcttcttcctggcagaacttcagatacttcttcacgccctgcgggaatttaatgtagttgccttcgttaatggagtaggtgtaacccttttccgggaagcgcatacgctcctggcacaggcagaagacgcccagagacggatcgtaagtgaaggcatgtacgccgcagccggtggtgtacaccagcatggtggaggagccatacaccacataaccggcggcaacctgcttgttacccggttgcaggaagtcttcttccgttaccggcgtgccgaccggcgtgacgcggcgatagatagagaagatggtcccgacagaaacgttaacgtcgatgttggaagagccgtccagcggatccatcagcaccacgtacttcgcatgctcgcacccttcgaaaaccacgatttcgtcttcttcttcagaggcaatgcccgccacgatgtcgcgtgctttcagtgcagatttcagtttttcattggcgaacaggtcgagtttttgctgcacctctccctggacgttttcggcaccactggcgcccagaatatcaaccagaccggctttgttaatatcccggtggatgattttggcccccagttttatcgccgacaacagtgacgtgagctcacccgtggcatgtgaaaactcatgctgcttttcaacgataaattcacctaacgttttcataacacttccctacattctatgtggagtaaagcgactgcaacaatcttaacaaagtttcaaaagattgcgcacaggtgaatcgcgccagcaaactacggaatatcctgaaatgcatttatctgaccgcggacatgtgggtaaaatgtgcgccagattaaagaaggataacgacgtatgcgcattcatatattggggatttgtggcacctttatgggcggcctggcaatgctggcccgttccctgggccatgaggtaacgggttcggacgccaatgtgtatccgccaatgagcacgcttttatcagaacaagggattgatttaattcagggttacgatccatcgcagctcgataacgcgccggatctggtgatcatcggcaacgccatgacccgcggcaatccgtgtgtggaagcggtgctggaaaagaacattccttatatgtccggcccgcagtggctgcacgatttcgtgctgcgcgaccgctgggtgctggcggtggccggtacacacggtaaaaccaccaccgccggtatggcgacctggatcctcgaagtctgcggctataaacctggctttgtgatcggcggcgtgccgggcaattttgaggtttccgcgcgtctgggtgaaagcccgttcttcgtcatcgaagccgacgaatatgactgcgccttcttcgacaagcgttccaaattcgtgcactactgcccgcgcaccctgatcctcaacaatcttgagttcgatcatgcggatatcttcgacgatctgaaagcgatccagaagcagttccaccacctggtgcgcatcgtgccggggcagggcaaaatcatctggccggaaaacgacatcaatctgaagcagacgatggcgatgggctgctggagcgagcaggagcaggtgggcgagcagggacactggcaggcgaaaaagctgaccaccgatgcttccgaatgggaagtgtggctcgacggcgaaagcgtgggccgcgtgaagtgggatctggtgggcgagcacaacatgcataacggcctgatggcgatcgccgcggcgcgtcatgtgggcgttgcgcctgcggatgcggctaatgcgctgggatcgttcatcaacgcccgccgccgtctggagttgcgcggcgaagccaacggtgtgacggtgtatgacgatttcgcccatcacccgacggcgatccttgccaccctggccgcgctgcgcgggaaagtgggcggcaccgcgcgcattctcgccgtgctggagccgcgctcaaacaccatgaaaatgggtatctgcaaagatgatttagcgccgtcgctgggacgcgccgatgaagtgttcctgcttcagccgcagcatattccatggcaggtggccgaagtggcggaagcctgcattcagcctgcgcactggcatgcggatgtggataccctggcggagatggtggtgaaaaccgcgcagcctggcgatcacattctggtgatgagcaacggcggttttggtggtattcatcagaagctgctggacgggttagcgaagaaagcggcggcggcttccgagccggtgtaatacagcgcccggtggcgcttcgcttaccgggcctacaaaaccatcaaaccgggaaccgtaggccgggtaaggcgcaagccgccacccggcaaaatgttaaccggtgcttactccgcgtcggcttccgccagctcgcgcaggtactggaaaatcagacgcgcagacttcggcgctttattcccttctttctcttttttcgcattgcggatcagcgagcgcagctgctgacggtcggcatgcggccacaggttcagcacgtccggcaccgcatcatcgccttcttcaatcagacggtcgcggatgtgttccagcttatggaaaaacgcaacctgctggttgtggcggtttttcagcttatccagcgcctggcggatcggatccacatcgcgctgacgcagcattttgccgatcaactgcatctggcggcggcggccttctttcttgatacgctgcgccagttcaatggcggcgcgcagatcgtcatccagcggaattttgtcgagggcatttttgcccagctcaaccatctccgcgccgaggcgttttaattcttcggcatcacgcttaatttcacttttactgacccagatgatctcatcatcttcatcatcgatctcatcaccgggctcgtcgtcgagccagtcttcgggctgcttggtcatctcaggctccttaaaaaagaggctaatactaacaccctgggagcacactgagaatgggttctctgttagacttctttgaaactccccttacattatggcattggcgatgaaagtaatcacacaagttgcagagcaacgcaaagcgctggaagaagccgtctccaccgcactgagtttagccgctggcaaatcggatggcgcggaagtgtcagtatcgaagacgaccggcattggcgtgagcacccgttacggtgaggtggagaacgttgaatttaacagcgatggtgcgctgggcatcaccgtttaccatcagaatcgcaaaggcagcgcctcctccaccgacctgagcccggacgccatcgcgcgcaccgtgcaggcggcgctggacattgcgcgctacacctcgccggatccttacgcgggcgtggcggataaagagctgctggcctttgacgcgccggatttagacctcttccacccggcagagatcaccccggacgaggcgattgcctttgccgcgcgcgctgaacaggcctccctcgccgttgataagcgcatcaccaacaccgaaggcggcagcttcaacagccactacggtatccgcgtattcggcaacagccacggcatgctgcaaagctactgctccagccgccattccctctccagcagcgtgattgccgaagaaaatggcgatatggagcgcgattacgcctataccatcgggcgcgcgttagacgatctgcaatccccggaatgggtcggcgcggaatgtgcgaaacgcacgctgtcccgcctgtcgccgcgcaaactctccaccatgaaagcgccggtaatttttgccaatgaagtggcgaccgggctgtttggtcatctggtcggtgccatcgccggcggcgcggtataccgcaaatccaccttcctgctggactacctcggcaaacagatcctgccggaatggctgaccatcaacgagcagccgcatctgcttaaaggccttgcctcgacgccgttcgacagcgaaggcgtacgcacagagcgccgcgaaattatcaaagacggcattctgacccagtggctgctgaccaactattccgcgcgcaagctggggctgaaaagcaccggtcacgcgggcggcattcacaactggcgcatcgacggtcgcggcctcagctttgagcaactgctgaaagagatgggcaccgggctggtggtgaccgagctgatgggccagggcgtaagcggcattaccggcgattactcccgcggcgcggcgggcttctgggtggaaaacggcgaaatccagtatccggtaagcgaaattaccattgcgggcaaccttaaggacatgtggcgcaacatcgttaccattggtgacgatattgaaacacgcagcaatattcagtgtggttcagtgctgttaccggagatgaaaatcgccggtcagtaattatcaataaaaacaaaaaggaagtgagcaatgcgtaaaaacatgctggcgttactggccatatcatccctctttgtaggtcaggcggcgcttgccgatctgggcgatgatatggatacgctgaatgaaaacctgaaagtggtgcagaaaaccgataacgccgatgaaatgaaagacgcgttaacgaaaatgcgcaccgccgcgctggatgcgcagaaagaaacgccgccgaaaatggaagataaagcggcagacagcccggaaatgaaagagtaccgccacggttttgatattctggtgagccagattgacggcgcgatgaagctggcaaacgaaggcaaggtcaaagaagcgcaggccgccgccgaagaaataaaaaccacccgcaatacgtaccacaaaaaattccgttaagcgtatttacccggcctgcacctgcaggtcgggtaagcgaagcgccacccgacatcagctacatccgcccataagcctttctaatacttgccacaaaaaccccgtatatctcacagatcggcattttcttttatgccggacgccgcgcggaacacggcgttataccgtgatgaaactcacactattccagccaaaaatcttctctgccgctttttctgtggaacagatcactgccgccactgacctttccacttcgaagtggaaaacaactcgctacaaactcttaacctgcgccgttagttttaacccggagacattaacggggtaagacgagtgaataacggagcggtaaacaacgacgcggggcgtctggcggacaccatgttaacgcaggtctacagcctgctggcccgccacaacattatccccaacgcggtacaggaacagatgctgacctcgcacgtccgtgccatggcgcaccgttcgataaccggcgaaccactgccggaggtcgatgccagcctgtttgacgagatctcagaagattcaatgtcacttgcccgtgaaatcgtggcggcgtttggcaaccttcccgaagaagaggcctggctgctgtcggtgcacttcgaagtggcgaaagacaacctgtaaggagcaaaagatggaacagattaccgtagtgattggcgatcgcctgggcaaaggtcagaaagtggcagccggtgtggaaaaagcgggtggacgcgccgtggtggtgccgggcgtggcggcagacatgaagctgggcgacgtcatgaaagcggaaaacgccacctttggcatttcattctgcggcagcggcggcgcaggggcgatcaccgcgcagaccaaatatggctacaaagccaaatacggcatgcgttctgtggatgagggcgtcaccgccatcaacgaaggctgcaacgtgctcggcttcggctttatggataaagaagagttaggcgagcgcctggtgctggcgtggcagaaaaagcacggcgcatgagtatgaaagagcatttcaccaccacggtgagagttaacggcaaaggcgagtcgaaatcgcgcgcctttgcggatgccctgaaccaggttcagggcgcggtgatgaaggcatcgccgcatattttactgcgtattgagccacaggatgtgcaggttgttcatgcgcgtgaagcggtgcgcaaagaagcatttctgtttttctttctgcgccgggagcgacgcacgttcagcgtggagctggacgttaccgtcaacgtgaccgccattaatctcgataaagtggcattcgtcacgcacacctgattttcaccatagggtttaactatgttcctgataattttaataaaatctctcatcatcggcggcctggtcggcgtgggtgtgggagccggggctgcacgcatgtttcacgcgccaaccacccagggaatgggggcgtttcgtaccttaggcgagctgaactcctgtgaaggggatccggcgtcgcacttctcctttggactgggctttttcttcaacgcctgggcctcgtccgtagcggcgggatccttcacccaggacgtcgatcatcgcatcatcccgaactggggcgcggcggcgctgatgatcaaaaaccgcaacgtcggcgagacgctgcacgatccgaaaaagatggccattgcctgcggcgtgatcggcatgatcgtcgtcgccttcctcaactccaccgcctcggcggtaccggcggccttacaggtgacggcggtaaaagtgctggtgccggcggcgaacctgctggtgaacaccgtcatgccggtgatcttctggctggcggccattgatgccggtaaaaagtccggcttctgggcgaccattttcggcggcgcggcgcagctgatcatgggtaacgccgtaccgggtctggtgctgggcattctgattggcaagggcgtggaagagagcggctggaaccgcgtcaccaaagtgatgatgagcgccatcgttgcgctgttcgtactgagcgccttcttccgcggcttcgacatgaaaatgatcgaatccttccacctcaccgtgccgaactggctggatctgatccacaacgcggtaagcggcaaataacaggagcctgacatggaacagaataaaggtttttggtacgccgactggtcattcccgatcttcgttggcctgctctcctccggcgtctttgccgggacacacatgtattacctctacggcatcggcgcgtttaacgaagtggcttttgtgtcgatgctgcgggcaggcatggacaccggcgtctacggcgcggtggcggcgttcggcgcgagcttcctgttcgcgcgcatcattgaaggctcgctggtgggtattctcgacatcggcggcgcgatccagaccggcgttggcctgggcgtcccggcgctgctgttaggcgcgggctttgtcttcccggtggcgaactttggcgcatcactggttaccggcctgctgataggcctggcgatcggttacctgatcatcctggcgcgtaaattcaccatcaatcagagcgactccacctacggggcggacgtgatgatgggcgcgggtaacgcttccggacgtttcctcgggccgctgattattctcagcgcaatgaccgcctcgatcccgattggcattggctcgctgattggcgcgctgctgttctacatctggcagaagccgatcaccggcggggcgatcctcggcgcgatgatcctcggctccctcttcccggtcgcgctgtaatcaaactcaaggagatgcgcatgtatgatttactcctgcgccgcgcgcggctggtggacgacactatcgtcgatatcgccgtgcaggacgggcagatcgcggcgattggcgagatcgacgcgccggccgcgaaaatcctcgatctgaacggtgagcactacgtcagcgcgggctggatcgactctcacgttcactgctacagccgttcacccatctaccgcgacgagccggacagcatcggcatcgccaccggcgtcaccacggtggtggacgcgggcagcaccggcgcgaacgacgtggacgatttctatgccctgacgcgcagcgcggtgacggaggtttacgcgctgctcaatatctcccgcgtcgggctgatcgcccagaacgaactggcggacatggcgaatatcgacggcgaggcggtacgggcggcggtaaaacgccacccggactttatcgtcgggctgaaagcgcgcatgagcggcagtgtggtgggcgataacggcatcgcgccgctggagcgcgcccgaacctttcagaaagagaacggcgatctgccgctgatggtgcacatcggcaacaacccgccgaacctcgacgacatcgccgcacggctgacgtcaggcgacatcatcacccactgctacaacggcaagccgaaccgcatcctgacgcctgcgggcgagttgcgcgcctcgatgatcgacgccctgcgccgcggcgtgcgccttgatgtcggccacggcagcgccagcttcagttttgaggtggcgaagcaggccatcagcctcggcattctgccgcataccatcagctcggatatctactgccgcaaccgcattaacggcccggtgttttcgctggcgcgggtaatgtcgaaatttctcgccatcggcatgtcgctgccgcaggtgatcgaatgcgtgaccgccagcgccgccgacggcctgcggctgaaacgcaaaggtcgcctggcggtgggctttgacgccgatctgacgattttcgactggcggcaccagccggtgctgttcaccgacgcagaaaacgacagcctgcatgccgacagcgtgctggtgccgctggcggcgatccgtgcaggtaaaggttatatgacaccacaagggagtgaagaacatgtcttcgatttatgaaaaatacgcgctcaaacaggtgattaacgcctccgggcgcatgaccgcgcttggcgtctccaccccgcgcccggaagtggtcgaggcggtgctaaccggcatgaaccactattttgagatgaaagatctggtgaccaaaaccggggactacatcgcaaaactgctggaagtggaaggtgcgaccgtcgtctcctgcgcttcggcaggcattgcgcagtcggtggcggcggtgctggtcaaagacagcgactggctgctggaaaacctgcacagcacgccgatcgaaaacaacgaaatcgtgctgccgcgcgggcataacgtcaactttggcgcgccggtcggcaccatggtggcgctgggcggcggtaaagtcgttgaagccggttacgcgaacgagtgctcggcggcgcagctggcggcagccatcaccccgcgcacggcggcgatcatgtacatcaaatcgcaccactgcgtgcagaaaagcatgctcaacgtcgaacaggcggcggtggtggcgcgtaaacacaatctgccgctgatcgtcgatgccgccgccgaagaagatttgcagtgctactaccgcgccggggctgatcttgtgatctacagcggggcgaaagctatcgaagggccgaccagcggcctggtgatcggcaaacagcagtatgttgagtgggtgaaacgccagacagcgggcatcgggcgcgccatgaaagtgggcaaagagggcattcttggcctgacctgcgccatcgaacactacctctccgcgcagaaagagagcggcgcagaaatggtggcaaaaatgacgccattcattgacggactgaatacgctggacggcgtcaccgcgcgcgtggtgtgggacagcgccgggcgcgacatcgcgcgggcagagatcaaatttgatgaagccgtcaccggtatcgccaccggcgagctggttaatgcgttgaaacagggcgagtacgccatctatttccgtggctataaagccaacgaaggcattatcgaagcggacgtgcgcagcgtcagcgccgaccagctggacattattattcgccgtattgccgacgtgctgaacaaggagcaaaccgcatgaccctgacgcccaatttctaccgcgaccgtgtctgcctgaacgtgctggcaggctcgaaagagaatgcccgtgaaatttacgacgccgccgaaggccatgtgctggtgggcgtgctgtcgaagaattatccggacgtggcgagcgccgtggcggacatgcgcgagtatgccgcgctgattaataacgcgctctccgtcggcctgggggcaggcgatcccaatcaatcggcgatggtcagcgccatttcccgcgaggtacagccgcagcacgtcaaccaggtctttaccggcgtgggcgcgagccgcgcgctgctcggccagtcggaaaccgtggttaacggtctggtttcccccaccggcacgccggggcaggtgaagatctccaccgggccgctgagttccggcgcaccggcgggcatcgtgccggtggagaccgccatcgcgctgttaaaagacatgggcggcagctcgatcaaatatttcccgatgggcgggctggactgccgtgatgagtatcagacggtggcggaagcctgcgcccgccatgacttctggctggagccgaccggcggtatcgatctggagaattacagtgagatcctgcgcatcgcgctggacgccggtgtaccgaaaatcattcctcatatttatagttccattattgataaagtaagcggtaatacccgcccggaagacgtgcgccagctgctggcgatgacccgggcgctactgccgtaaccagaggacaccgacgtgcgatttccgaaccaacgtttagcgcagctgttcgacatgctgcaaaacgagacgctgccgcaggacgagctggcgcagcggctgtcggtgtccacgcgtaccgtgcgggccgatatcaccgcgctgaatgcgctgctcgccagccacggcgcgcagtttatcctcagccgcggcaacggctatcagctgaaaatcgacgacgccacccgctttcactccctgcaaacggatcgcccgcgcgcgctgcgtattccgcgcagcgggcaggagcgggtgcactatctggtggtgcgttttttaacgtcggccttctccctcaagctggaagatttagctgatgaatggtttgtcagccgggcgacgctgcaaagcgatatggcggaggtgcgtgactggctacagcgctaccatctgacgctggaaacgcgcccgcgtcacggcatgaagctgttcggcagcgaaatggcgatccgcgcctgtctgacggatctgctgtgggagctggcgcagcaggacgcccacagcccgctgttaaccgaggaggcgctgaaccgcggcgtgccggaacagcttgagaggctgctgcatcagtgcttcacccgccatcatattcgcctgacggatgagggcgagctgtttatccgcctctactgcgcggtggcggtgcggcgcatcagcgaaggctatccgctgccggaattcacggcggacgatggcgatgaaaatgtccacctcgccgcgcgggagatcgccgccaccctgcaacagctggcgcagaaaccgctcgccccgtcggaagaagcgtggctgcgggtgcacatcgccgggcgacaggtgcaggagatcgcgccgagcgctatcaatgccgatgacgacgaagcgctggtcaactatatccttggctttatcaatacccactacaactacaatctgcaaaacgatgcccagctgcatgcggatctgctgacgcacattaagaccatgatcacccgcgtgcgctaccagatcatgatccccaatccgctgctggataacatcaaacagcactatccgatggcgtgggacatgaccctcgcggcggtgtcgggctggggcaaatacacgccctggacgatcagcgaaaatgaaatcggcttcctggtgctgcatatcggcgtcgggctggagcgccattacaatatcggctatcagcggcaaccgcgcgtgctgctggtgtgcgatgccggtaacgccatggcgcggatgatcgaagcggtgctgcaacgcaaatatccgcagatcgaggtcaccagcacggtgacgctacgggattacgaacagcgcgacagcatcagcgaggactttgttatcgccaccgcgcgcatcagcgaaaaagacaagccggtggtcaccatcgcgcctttccccacggattaccagttagagcagatcggcaaactggtgctggtggatcgcacgcgtccctggatgctggagaagtatttcgatgccagccatttccgcattatcgatcgctcggtcgatcagcagacgctgtttgcgatgctgtgcagccagctgcatgaggagggctttgtcgatggggagtttgttgattcggtggtggagcgtgaggccatcgtcagcaccatgctcggcgacggcatcgcgctgccccacgcgctgggactgctggcgaaaaaaaccgtggtctataccgtgctggcgccggaaggcatccagtggggggatgaagtcgcgcatattgttttcctgctggcgatcagcaaaagcgaatatgaagaagcgatggccatctacgatatttttgtcaccttcctgcgggaacgcgcgctgacccgcttatgcgcctgcaaagattttaccgaatttaaaaccgtcgccatggaatgtgtgagccggttttaattaaggtaaaatatttatattaatgcctgcgctagcgggtatttttatttttacaagtttccccgtgaggttatttatcttttcggtggaagatcctgcggcagtatttcctgcccggtaatggcatcgacgatttgctctgagccatcaggatatttggttacggataccagccggccgccgtacagcgggatgccggacatctccagcgtataatccgttttcttaatttcctgtttcttaagctcttgctgcttcttgatttcttccggcgtctgcgaagacagcgtaatcttcgtggcgctttcttcggcgtccagcggcgatttgtcagtattaacgtctgtggatttactgttattccagacagtcgggttattatcctgattagataaaagcgattcaccgtgcgtatttgtcgcggtgattttttcaataccgttcatcatcatctccgggtcgaaaatgcaatagggcgcaggacgcggtgcgctcttttcgggaagagtgcgcagcatctgcaagggataaaggtgacaaaaaggttatcggcggggcagcgaaataatttaatacaaaataatcaacgtgcggtcgttctgtttttttgaaggataaggacaaattgttctactttcatgattgcgccgtcaggcttactctgtaagaacagccgacagaatttgaagtgaaaaacattcaggagaacgtatgtcagacaactttatttcgctcgcgacgcaacgcagaaccatctatgcactgggcaaggacctgccggtatcagaagatgaagtgattgccaccattcaggaagccattcgtcaggcgccttcggcattcaactcgcagagttcccgcgcgctgatcctgctcggcaacgaacacaataaattctgggagattgtgcgtgaacagttaagaaaaattgttcctgcagagagcttccacgccacttccgacaagctggacggcttcgccgccgccgcgggttcggtactcttcttcgaagatcaggacgtggttacccgtctgcaggagcagtttgcagcttatgccgataacttcccgatctggtcagaacacagcaccggtattgctcagtacgcggtatggctggcgctggcagagaagggcattggcgcgaaccttcagcactataacccgctggttgacgcagatgtgcagcaggcctggaatatcccggccagctggaaactgcgtggacagatgaattttggcgccatcctcgcaccggcgggcgataaagcctttatggacgacgacaaacgttttgtggttgcccgttaattaagaatgccgccagcaggcggcattcttattattgtaggtcgggtaagcgcagcgccacccgacaaacaagcccaattaccgcaaataatgcaccacctggttgctactcccgcgccagatcagcgacggatctttcagatcctgcacaaacttcccgtccaccagcacgttaatcagctccaccaccgccatttgcgcggcagttaactcctcaagcttataacccgtccacacccagatatccttgccggggcattcggcacgaatgcgctgcaccagcgccaggatctccggcacgttttgcggatgcagcggatcgccgccggacagggagatcccctggcgtttgatccgcgtatcgttcaaatcactgataatttgatcggccatttcacgggtaaacggctgccccgaattgagccgccaggtgcttttgttatagcagccagggcactcatgcacgcatccggaaacaaacagcgtgcagcgcgttccggggccgttcacgatatcgacggggtaatattgatgaaaattcataatgcataaccttgccgggtggcgcttcgcttacccggcctacagtgacagccgggtggcgttgaaggacacagactcaaccgatctgcccgtttcctaaatgcttcacgcggcgcttcacttcttcctgcttaccggcgttaaacggacgcgcatccgggctgcccagataaccgcatacgcggcgggtcaccgacacccgcgcggcgtcgtggttgccgcatttcggacaggtgaagcctttgctggtgcattcgaactcgccggtaaagccgcactcgtagcactcatcaatcggcgtgttggtgccgtaatagggcacatgctgatagctgtaatcccatacgtcttccagcgctttcaggttgtgctgaatgttcgggtattcgccgtaacagatgaaaccgccatttgccagcggcggatagggggcttcgaaatcgattttgtcgtacgggttcaccttcttctccacgtcgaggtggaaactgttggtgtaataacctttgtcggtgacgcccggcaccacgccgaactcggcggtatccagacggcagaaacgatcgcacaggttttcgctcggcgtgctgtagaggctgaagccgtagccggtctcttctttccactgatccactgcctgacgcagacgttcgacaatggcaatgcctttcgcgcgcagcgtctcgctgtcgtacatgtgttcgccgcccgccagcgcattaatggtttcatggatgccgatatagcccagcgaaatggacgcgcgcccgtttttgaaaatttccgacacctcatcgtccgccttcagacgcacgccgcaggccccttccatatagagaatgggcgcgacgcgggctttcacgccctccagacgggcgatacgggtcatcagcgctttccgcgccagctgcaggcgggcgtccagcagtttccagaatgtggcttcgtcgcctttcgcttccagcgcgatgcgcggcaagttcaggctgatcacgccgaggttgttacgcccgtcgtggatctgctcgccgttttcatcttcccagacgccgaggaagctgcggcagcccatcggggttttgaacgagccggtgactttcaccacctgatcgtaattgagaatgtccgggtacatgcgcttgctcgcgcattccagcgccagctgtttgatatcgtagttggcatcgccaggcttgtggttcaggccgtcgcggatggcgaacaccagtttcgggaacacggcggttttacgatttttgcccagtcccgcgatgcggttacgcaggatcgactgctggatcagccgcgattcccagctggtgccgaggccaaagccaaaggtgacgaacggcgtctggccgttggcggtgtgcagcgtattcacttcgtattccagcgactggaaagcgtcgtagcactctttttcggtacgggaatgggcgtagccgtccgcatccgggatgtgccactcttccgccgttttgcggtgttttttgaagctggcggtgacaaaaggcgccagcacttcgtcgatgcggttaatggtggtgccgccgtaaatatggctggcgacctgggcgatgatctgcgcggtcaccgccgtggcggtggaaatagattttggcggttcaatctccgcgttgcccattttaaaaccgtgggtcagcatgcctttcagatcgatgagcatacagttgaacatcgggaagaagggcgagtagtcgagatcgtggtagtgaatatcgccacgctcgtgcgccagcaccacgtcacgcggcagcagatgctgacgggcgtagtgtttggcgacgatgcccgccagcaggtcgcgctgggtggggatcactttgctgtctttattggcgttttcgttaagcagcgcggagttggtttgctccaccagaccgcggatctcctgattgaggcggccacgtttttcacgctcaatatcccggtcatggcgatattcaatataggcgcgcgccagctgcttgtacgggccggacatcagctggttttctaccgcagtctgaatttcattgatatccacctgactgcggcccttcatctgctgtcccacgacctctgcgacggtggcgcaataatctgcgtcatcgactcccgctgctttagctgcacgcaaaattgcttcctgaatgcgctctgagttgaaaggcactttacagccatctcgtttcatcacatgcggtgtcatgatctctccatttagaaacaggttatccacaaaagcggaataatattcacagcgggcatacgtctgtgccagcaggtttttcctcgcgcacggtcttttttatccacaaatctgagggataaaccagcggtgtggttgttgcaatattagacaattaatacaacatattgggtcggggcgggattttaagtcctatatatagtgatttgcatcaaacaagtttgcgattttattgatgcaggacaaggtaaaaacatgaccgtacagatggcgggcgttgcggggaatgtaaattctgatggagcgtttcgtggtttattgcgctctttttcgctccgacgaacggctttggttccagtaagttccgacaaacataaagccactcagtcgtaacaaaccctcatcgtaattaacgcgaggggttgagtccccgctgaaaccggcgagccggaggccggatgacaagggctggccgccatggatggcggccagaggcgatatgaggcaggaggccgaatcgagccgaccgcaggcagacgggcgggaggtgagcgcagtgcgcagcaccggtttctttgcggggccgcagggattgctaagggggccgcggtggcccccttagcacgttcaccgtcagcggcgtcacgcctgacacggaacgcaaagtgaacggaacattccaccgcaccgaacatcccccaaaaccaaacggaacattccacctgccctcatctaaaactaagcctccccctgcctccaccacaccgcctcatacggccttaacaccgccttcgcaggggcctgcgccacctccgcataattactcatcaccacccgccagtcgcccgccatctcctccggctcccatgcctgattctccccgctcagattcgccaccaccagcagcgtctgcccctgccactggcggcgataacaccacacgaaaggatgcgcaggcagcagatcctcataatctccccaggtcagcaccggctcgcgtttgcgcagcgcaatcagcgcctgataggtataaaacaccgagtccgcatcgcgcagcgccgcctccacgttcacctgcggatagttctcgcacagggcgatccacggctcgccccgggtgaacccggcatggggagaggcatcccactgcatcggcgtgcggctgttatcgcgggatttggaggcgaggatcgccagcagctgatcggcgtcctgaccggcggcgcggcgttcggcaaacatattgtggctttccacgtcgcggtaatcggtaatacgcgtaaagtgcgggttggtcatgccgatctcttcgccctgatagatatagggcgtgccctgcataccgtgcagcaccatggcgagcattttcgccgaggtgacgcggtattccccttcatccccgaagcgcgacacgatgcgcggctgatcgtggttacaccagaacagcgcgttccatgccacctgatgcatcccctgctgccagtagcggaacagcgtcttcagcgccacgaaatccggggccgccagcgtccatttctcgccgccggggtagtccactttcagatgatggaagttaaaggtcatcgacagctcgcggccatcctgggcggcatactgccgacagtgatcgagggtggtggaggacatttcgcccaccgtcatcagtccgcgcgggcggaaaacgtcgcggctcatctcctgcaaatattcatgggcgcgcggcccgtcggtgtaaaaacgacgcccgtcccccagctcatccggcggaaaatcctgatctttggaaatcagattcaccacatcaagacgcagcccgtcgacgccgcgatcggcccagaattcacacacctttttcagctcggcgcgcacctgcggactttcccagttcagatccgcctgctccggagcgaagaggtgcagatagtactgcccgctctccgcatgccagcgccaggcgctgccgccgaatttcgagcgccagttgtttggcggcgtcaggggcgagccgtcgcgccagatataaaattcgcggtacggactggcgggatcctgcgcatggcgaaaccaggcgtgctgcgtggaggtatggtttaacaccatatccagtacgatgcggatgccgcgcgcatgggcctgggtcaccatctcgtcaaaatcgtccagcgtgccgtatcccggatcgatggcggtatagttcgccacgtcgtagccgttatccacctgcggcgagatataaaacggcgtcagccagatggcgtcgacgccgaggattttcagatagtcgaggcggtgtgttacgccgcgtaagtcgccgcgtccgctgccggtggtgtcctggaagcttttggggtaaatctggtagatagcgccggtctgccaccagtggggaagtgtattcatcgtgtcgtcccgatcgtaaaaaggggcgccgtcgcgcccccgaagcatcaaacaatctgtagcgatccctggcgggctttgcgctggtacataaaggtcgtgagcactaatggcacgacaatggcgataaccatggcgatgccgtagacctgccagtaaccggtctggatagaaagaatacccggcagaccgccgacgccgatgccgttcgccatcacgccgtataatccgcacagcagcgcggcgaggcaggagccaatcatcgcgcacagcatcgggaagcggtatttcaggttgataccgtacattgccggttcggtcacgccgaggaaagcggagatagcggcaggcaccgaaatctcacgttcattctctttgcggctgacgatgatgatccccaccacggcggacgcctgagcgatgttcgacagggcaatcagcggccacattggtgtgccgcccatgctctggatcatctgcatatcaatagcgagcgtggtctggtgcaccccggtgatcaccagcggcgcatagaggaagccaaacagcgccgcgcctatcggggcgaagctgccggtcatcagatggcgcatggcaaaggccacgccgtcgccgatcagacgaccaaaggggccgataaaggcatgggcaaggaacactgcgaggagcagcgagcagaccggcaccaccaccagatagaggtaggcggggacgatacgcttcagctgcaattcaatatagccaagcgccagacccgccagcagcgccgggatgacctgcgcctggtaacctactttatcaatgctgaacaggccaaagttccaggcttccggcacctgctggcccagtaagtaagcgttcattaactgcggcgaaaccagcgtaatgccgagcacgataccgaggatcggcgtgccgcccattttcttcaccgccgaccagcagatccccaccggcaggtagaagaagatcgcctcgccaatcagccacaagaagtcataaatggttttcagcgccggggacatttgcgccagcgtctgtccgttgctcatcggcagatcgccgataacgttacggaagcccagaatcaaaccgccgctgatcagcgctggcagcagcgggaagaagatctccgcaaagtgcgagatcagctgctcgtaccatttcatattctggcgcgccacccgtttggcgtgctctttatccgcatgagcctgaccggtagtggcgagcaggactttgtagtagtcgccgacatcggggccgatcaccacctggaactgtccggcgttggtaaagcagcccttcaccattttcagtttttcaatggctttcggatcggctttcgccgggttatcaagcacaaagcgcaggcgggtaatacagtggctgacggtggcgatgttatcccgtccgccaaccagctcgattaatttatcgatgtcagcttgatctacttttttgctcatcgtgaagcctcacagaggttttggaattatgcgtagggaacagctgaaagagtatctgcggatcggcaaaagcgaaaagggaacgttcccgaaatcggttaaggatcacactaaatcatacaagcatagattaaccgaggcgggcggggacgataatggtgcgcggttcggcgcggccggtgatctgatcgatcagctgggtggcggccatacggcccgcttcagcgtagccgggatcgacggtgacgatttccggatgcaggaatttcatcagcggcgtattgccgacgctggccagttgcagggcggtgatgcgctgctcctgtaagtacttactcgcgccgagcgccagagtatcagtggcgcagaccagcgcagtagtgtccggcgttaagacgcgggcgacgtgctcataaccctgtttcatcgccaggcccggcagcacggcgacgggctgcatctgatgctgtgcgcagaaatgcagataggcgtcgtggcggcgctggccggtggtggtgtcgctggcaggcacgccgagatagctgatatgccggtgcccctgggcgtagagcttttccagcagcatctggatcgcccgttcatcgtcataacagacggaggcgaagccgctggcgtcccgcgccatcagcaccagcgaagactgccagggcgcaagcagggtttccgtgaggccagtaaagccgaacagcaccacgccgtcgatattgcggcgacgtaacatgccaagatgctcttccaccagcgccggagagaactgactttccatcatgatcggatcgtaaccctgggcgtaaaacgctggcagcatggtctgtaccgcaaggttttccgacagcgaatccaggcgcgtgacgatgatcgccacgatgttatcgctctggccgcgcattgcccgcgccgagcgggacggggagaagccatgctgttgcatgacggcttccacgcgctcacgggtctggacgctgacgccgctctcattattgagcacgcgcgaaacggtggatttacccacgccgcttaagcgggcgatgtctttgattgtcagtcggttttgcatgcgtcctttcctttgaggtcggtatcagcctaatgattctgcgacaaaatacaatgcacaacgtctggtttacgtccggtttagttgccgggcgttattatgcgccgcaacttcaccttatcacttttaccggaggcaacatggatcctgatcccacccctctccccgacgggagttttcccgcgttccggtaagcctgttttcgctgccttgccggacgcgtagggcagcgacgttttacgtccctgcaaaataacatttgcgcctgcgggcgcagagggactttttatgctgaaaaattttatccggcagcgcttctttgcgctcagccgccatttaccacgccgtctggttgaccgcagcccgctgccggatgccactaccgcaggcgtaaccccgatcccggcttcgctcagcgctcactgcctcaacgtggcggcgatggacgaatctcaactgtggcgcagcttcggcagccatcctgaagggcttaacccgcaggaagtcacggccagccgcgacaagcacggcgaaaaccgcattccggcgcaggcgccatcgccctggtgggtgcacctgtggctgtgctatcgcaacccgttcaatttattgctgacgctgctcggcgtgatctcttacgccaccgaagatatgtttgccgcgggggtgatcggcctgatggtggcgatcgccacgctgctcaattttatccaggaagcgcgatccacccgcgccgccgacgcgctgaaagcgatggtcagcaacactgccaccgtgctgcgggtgatcaacgacaaaggcgaaagcgcctggtgcgaactgccgctggaagaactggtgccgggggatattgtccggctggcggcgggggatatgatccctgccgatttgcgcgtgatacaggcccgggatctgttcgtggcgcaggcctcgctgaccggcgaatcgctgccggtggagaaactcgccgtcacacgtaatgccgcgcaaaccaatgcgctggagtgcgacaccctgtgctttatgggcactaacgtggtgagcggcacggcgcaggcgatggtcatcgccaccggcggcaacacctggtttggtcagctggccgggcgcgtcagcgaacagcccaccgagccgaatgcgttccagaaaggcatcagccgcgtcagtatgctgctgatccgttttatgctcgtcatggcgccgctggtgctgttgattaacggctacaccaaaggcgactggtgggaagcggcgctgtttgcgctgtcggtggcggtgggcttaaccccggaaatgctgccgatgatcgtcacctcgacgctggcacgcggcgcggtgaaactgtctaaacagaaagtgatcgtgaaacatctggacgccatccagaacttcggcgcgatggacatcctgtgcaccgataaaaccggcaccctgacccaggacaaaatcgtgctggagaaccacacggacatcgccggaaaagttagtaagcacgtacttcacaccgcgtggctgaacagccattaccagaccggtctgaaaaacttgctggacgtggcggtgctggaaggggtggacgaagacagtgcgcgggagctttccacgcgctggcaaaaaatcgacgagatcccttttgattttgagcgccgccgcatgtcggtggtggtggcggaaacgccggatgcgccgctactgatttgcaaaggggcgttgcaggagatgctcagcgtctgtagccatgtgcggcataacggcgaggtgacagcgctggatcaggctatgctgcgccgcatcgagcgcgttacccagacgctcaaccgtcaggggctgcgtgtggtggcagtggcgagtaaatacctcgcggcgcggcagggggattatcagcgtgccgatgagtcagacctgatcctcgaaggctatatcgcgtttctcgatccgccgaaagagagcaccgcaccggcgctgaaagcgctacacgccagcggcatcacggtgaaaatccttaccggcgacagcgagctggtggcggcgaaagtgtgccacgacgtcgggctgaacgcgggcgaggtggtcaccggcagcgatatcgaagggttaagcgatgacgagctggcggcgctggcgcagcgcaccacgctgttcgcccgtctgacgccgatgcacaaagagcgcatcgtcacgctgctaaaacgtgaagggcatgtggtgggctttatgggcgacggcatcaacgatgccccggcgctgcgggcagcggacattggcatttccgtggacggtgcggtggatatcgcccgcgaagccgccgacatcattctgctggaaaagagcctgatggtgctggaagctggcgtgatcgaggggcgtcgtacttttgccaatatgctcaagtacatcaaaatgaccgccagttctaacttcggcaacgtgttcagcgtgctggtggcgagcgcgtttctgccgtttttacccatgctgccgctgcacttactgatccagaacctgctgtacgatgtgtcacaggtggcgatcccctttgataacgttgacgatgagcagatccagaagccacagcggtggaaccccgccgatctggggcgctttatgctgttctttgggccgatcagttcgatcttcgacattctgacgttctgtgtgatgtggtgggtgttccacgccaacgtgccggaagcgcagacgctgttccagtccggctggtttgtggtggggctgctgtcccagacgctgattgtgcatatgatccgcacccgccgcgtgcccttcttccagagtcgcgccgcctggccgctgctgatgatgacggcggtagtgatggtattgggcatcgggctgccgttctcgccgctggcaagctatctgcaactccaggcgctgccgctggcgtacttcccgtggctggcggggattttgctggggtatatggcgttgacgcagctggtgaaaggattttacagccgccggtacgggtggcagtgaggggggagttgtgctttaacctgtttgccgggtggcgctacgcttacccggcctacaggttagacgtaggcccggcaagcgcagcgtcgccgggcaacgatgctttaacggcgtaccgcaatcgcttcgatttcaatcttcacatctttcggcagacgcgccacttccacgcaggagcgtgccgggaaggtggcgttatgctcggtgaaaaatgcttcataggtggcgttaacggtggcgaaatcgttcagatctttcacaaacaccgtcgttttcacgatgtcgcccactttcaggcccgctgcttcaacgatagctttcacgttttccagcgactgacgcgcctgagcggaaacgtcgtccggcacggtgccggttttcggatccaccgggatctgcccggaagtgatgatcatactgcccagatcaacaccctgaacataaggaccaatggctgctggtgcattttccgtcgcgatggttttagtcatgatttctcctgaataacagcgaaaataaggggttccgcgccattataggcagcgcagaacccattaccaacctcaattagctggccagcaccacataatgggaaaactctttttcacagtatttgcatttgagcgcgatgtcgctggcgcgttttttcactgcaaaactggagaaaaccggttcggcatggctgatgcagttactattcgggcacaccagcacggcgtcgatgcgctccggcagtttcgggcgcgattttcccaccacttcatactcatcaatgcggtttaccgtcgcgtccggcgcatataaagagagctgatccacctgctcatcggtaagaaaagtgttctcgattttgatcagatctttgcgccccatttcgcctgacggcaaattcaggccgatggtgatgcgctgatcggtttcggtcagcttgaacagcgtcagcagcttaaagcccacctgcgccgggatatggtcaatcacggtgccgcgtttgatggcttcgacctggagtttattatcgtgtgtcatctcagtgctccttacagaaccaaatcgcgattaagaaccagcgccagcagcgcctggcgggcaaagatgccgttaccggcctgctggaagtaccaggcgtgcggggttttatcgacatcggtgtggatctcatccacgcgcggcagcgggtgcagcactttcatattggcgcgcgcatgcgttaagtcgctggcgcgcagtacaaactgcgccttcacgttggcgtattccgacggatccaggcgctctttctgcacgcgggtcatatagagaatgtccacttccggcatcacctcgtcgatgctgtcatgcacgctccacgcaatgcccttttcgtcgagcatatccagaatgtactgcggcatcgcaagtgctgcaggcgcgataaacaggaagcggttgccgctgaatttcgccagcgcctgcgccagcgagtgcacggtgcggccatatttcagatcgccgaccatcgcgatattcagattttccaggcggccctgggtttcctgaatggtaaacaagtcgagcagggtctgggtcggatgctggttcgagccatccccggcattcagtaccggaatgccgccggaaaactccgtcgccagccgcgccgcgccctcctgcgggtgacgcatgacaatcgcatcgacataggtgctgatcaccgaaatggtgtctgccagcgtttcgccttttttacccagcgaggtgttgctgctatcggagaagccgaccacgctggcccctaagcggtgcatggaggtttcaaaagagaggcgggtgcgcgtggaggcctcaaaaaagcagctggcgatcactttgtgcttaagcagctccggttgcggcgtggccttcagtctggcggcggttgccagcaccagttccagttcttcgcgactgagatcatttatggaaatgatatgtttttgatagagcggattagccatcgttctctcctgacgcctgcgcaaaaaaaagcccctcaataagaggggctgtgaatatcgtgagcaacgggaagaaaaacggcaggcctgcgtctgttttcagacgcggtaagacgcgatgtcgtacgcagttgaccatgctttcctcccggcaaattgcccggcattatactcagctgcttttgtggatcaagtgattcaatgcacgatttgtataaggcaaacggttattttgcatatcaatgcattcttaacagataattaacgcgtttatgcaccagtgcggtacgcgagacatcccgtggcgcgacccagacaatgttgctgctcgccaccacgccgagaatgtccgggatcgcatgataatccagtatcctggcgacggcgcgcccgtatccggcggcggtatggataaggataaactcactattgtgctcaacgctgaccaccatttccgacacggatcgcgcggcatcgggtgccgggcgtaactgtggattcacggaataaatcttttgtcctttcgcgttgcgtatttttatcacgcccagcagctttaacagccgcgaaacggtggactgactgatgctgtcaaaaccatgcagctgtaaatcgcggcggatcgcctcctgcgataaatagcttttctccacaataagacgctggcagacagcgagctgaagttgctctctggcggtgcattctgcgtattccttcatcgttttattccagttagttgccaaaatgcccggtggcgcgcgccatccggcgaaaactagagcagggcgccaagacttaacacaacggtgatcaccaccgtcaggatcaacagcaagggcgcaacccacttcaggtaacgcacataaggtacgcgcgcaatggccaggccgcccatcacaacggcagaggtgggtgtgatcagattcacaatgccggaggcggactggtaggccgtgaccaccagatcgcgattgacgttagcgaaatccgccagcggcgccatgatcggcatggtcagcaccgccagacccgaggacgacggcaccaggaaagagagcaccacttccagccagtacatgacattgataaaggcgacggtggacagcccgctcaccatcccttcggcgctgtgcagaatggtatgggtgatcatgcctttatccatgatcaccacgatgccgcgcgcgatgccgatgatcaacgccacgccgagcagatcccgcgcgccgttgataaaggtggaggtcagctcctcttcgctcatgcgggcaatcagcccgacgataatcgccgccgccagaaacaccgccgagatctccgccatccaccagccgagcaccgccacgccgtagatcattaccgcgaaggcgagggcgaagatcacgaggataagtttgcgcaccggggtgaattccagcatctcctgcggcttatcgccaagaaaatgcgcgcggttttcgtcaagcttatccgccacgatggagctggccggatcctggcgcactttacgggcataacgcatcacccaggccacgcagatcagccagcctaccgccagcaacagcacgcgcagtaagatgccgttggtaaaggggatcccggcggcgttggcggcgatcaccgtggcaaagggattgatggtggatccgagcgtgccgatccccgcgccaagcagaatggttgaagcagccaccaccggatcaaaacgcgccgccagcatcaccggcaccagcagggtgtaaaacggcagcgactcttccgccatgccgtagatggtgccgcccgcagcgaacaggcccatcaggatcgggatcatccactcttcgtggccgtgcagtttcagggtgacgcgggcgatcccggcatcgatcgccccggttttggtgacgatccccagaaagccgccgatgatcagaataaagagcgccacgtctatcgcgcccgcctggccggtgacgggatcgtacagcccgccgatgggggccatcagcacggcaaccagcccctgcggatgggcggcgacctgcgcgtaggtgccggccaccggcacttctttgccgagggtctcgttcatcatcatctgatactgcccggcggggacgatccagctcagggcggcgaccagcgcgatgaggataaataaaatggtgtaagcggaaggaaatttgaacttgcccatggggtgatctccctgtgcgggcgcgccagctcaccggcgcgcccggataattactcgccgagtgtcgccaccatgaccgctttaatggtgtgcattctgttttctgcttcgtcgaaaacgatggagttcgccgactcaaacacctcttcggtgacttccagccccttcagcccgtaggcgatttcgatttcccggcccatggtggtgtgctcgttatggaacgcgggcaggcagtgcataaatttgacgttcgggttaccggtggctttcacgacggcgctgttgacctggtaaggtttcatcaggctgacgcgctcggcccaggcttctttcggttcgcccatcgacacccagacgtcggtgtagagaaaatcaacgccgttgacgccttcttcgacgtcctccgtcagcatgatgcgcgcgccggtttcgcgggcgatagcgcggcactgcgccaccagcgcctcttccggccagaaggcgcggggcgcgaccagacggatgtccatgcccattttcgctgcgcccaccatcaggtcattgcccatgttgttacgtgcatcacccagataggcgaagcgcagttccggcagggtcttgcccggcgcatgttccagcatggtcatcaggtcggcgaggatctgcgtggggtgaaattcgttggtcaggccgttccataccggcacgcccgcgaattcgcccagttcttcgacaatggcctggccgtagccgcggtattcaatgccgtcatacatgcgtcccagcacgcgggcggtgtctttcatcgactctttgtggccgatctgcgaaccggacgggccgatataggtgacctgcgcgccctgatcgaaggccgccacttcaaaggcgcagcgggtgcgggtggaggttttttcaaaaatcagcgcaatgtttttcccggtcagggttggctgttcacgtccggcttttttggcggctttcagttcgatggccagatcgatcagcgactggatctccgccggggtgtaatccagcagcttgaggaaattgcggtttttcagggagtgggacataagtatttccttattcagtttttaacgcctgatggcggctgcgccttatccggcctacaggccgtaggccggataaggcgcagccgccatccggcaaaagggtatgaaggcttaatgccggatcaacgtacctttctcaccggcgaggatcgccgggccgtccgtcagcgcgcctatcccggcgatgccgtggcactcgtcgacaaaacggcaacaggcggcgactttcggccccatggatccggcatcaaaggtcattccgttaagctgttctggcgtgacctgggtgagcgggcgctgggctggcgtgccccagccgacatagaccgcatcggcatcggtgaggatcagcagcgcatcggcttcgatctgccgcgccagcagagccgcggagagatctttgtcgatcaccgcctcgatgccgtggtagccgtcggctttctccaccaccggcacgccgccgccgccgttgcagatcaccagatggtcacggccgatcagcgcgttaatggcatcgcgctcgacgatgcgccggggctgcggcgagggcaccacgcggcggaaataattcccgtcggctttgaaggtccagtctttttccgctttcagtgcggcggcctgggcttcgtcatacaccgggccgatgtatttggtcggctggcggaaggccggatcggcggcgtccacttccacctgcgtgagcagcacgctgatctcccgctgcggcagcaggtttttcagcgcctgttgcagcatgtagccaatcattccctggctttccgcgcccagcacatccagcgggtagggcgtgaccttgtcataggcgctgttttgcagcgccagcaggcccacctgcggcccgttgccgtgcaccagcaccacgcgccagtcgtgagtcagccgggcgatggtctgcgccgcgagcagaatatttttgcgctgaatatcggcttccagcggctcgccgcgttttaacagcgcattgccgccgagggcgacgacgagagtgggtttcagttgcatgggcgtctccttaaatgccgtcgcgttcaagcgggcagctcatgcaacgcgcgccgccgcgaccgcggcccagttcgtcgccggggattggcagcacggtgatgcctgccttatcgtatttttcgttggtccagatgttgcgctcatagcccaccaccacgccggggcgcagggttaacacattgttggcgtcgttccactgttcgcgttccgcttcaaaggcgtcgccgccggtggtgatcaggcggatctgcgtcacgcccagggctttttccagtgcaggcaacaggccaggctcctgtaaacggctgatgccgccgcgtccgtccggggtcagcgtccagcactgggcgtctttgcgcaccacttccgggtagacggagaaggtatcgacgtctatatgggtcatcacggtatcgaggtgcatacaggagcggtgcttcggcagttccacggcgatcacccgctcggcctggcgatgtttaaacagggcgctggcgaggaattccaccccctgcggcgtggtgcgttccgacataccgattaataccgcgccgcggccaatgactaatacgtcaccgccttcgatggtggcatggtcataattaatattttcatcgccgaagtatttaataaaatcgccgtcggcaaactgtggatgccagcgataaatggcgcgcagattattggtttcccgctgacgcgccggtttcgccatcgggttaatagacacgccgttatagatccagcaggaggtatcgcgggtaaataaatggttaggcagcggcttcataataaagtcattcgctgaatgggtatccaccaccatatttttaataaaggccggtatttcgccgtaggtcaggccgccgcttaaacgccgcgccagttcgcgatgcggcatatccgccagccagccgcgcacgtcggcggcaaaggcaggcccgaggcggtaatccgacacctgggtttgcaacagccagcctttggcgtccgggacgtccagcgtctgggtgagcagatcggtgagcagtaacacttccacgccctgatcgcgcagcgtagtggcaaaaatatcgtgctcctcgcctgcacgctcaaccgataacacgtcatcaaataacaactcctggcaattcgatggcgtcagtcttttcaggctaagattggggcgatgcaacatcacgctacgcaattggccaatttcagaaccgacataatgcttttccatatttattccttgcacttttttagaaataaaggggccagcgttatgaaaagactattttcataacccttcgtattcaggtgaattcggcggtaatactaatggctgtcgctattaataatgtgatattgctcacgtgaaaccggcactgttgaggtttatttcttattgcatgacgggcatcagagaatactcaaatggctattttaaagcggtgcattgctacgcattaattgctgtcattatttttagttgttaatgttttgtacattgactcattaattatattttatctatcatgctgaaatttatggataaaataaagatgttcgcatgaatatgcaaaatggctaataaattattgcggcattaagtcgaattaaaaaataaatatgaaatggtgtgcctgaatatgccgtacggcaaaatgtgagcagtaagtggtttttttgataattacattattttcagcaggttgcagagcaaggtgcaaagccggcgcaaaaagttatgcagtattactgcatacgcccggacgcatcgttaacagtctggtaacaggcttgcagataaacatgcgttatcgcaaatcttttccatttagaggtggtgcagcaaaaggatttttcgtataacacataaaaatgaaacagtgttttatatgaggggttcatcatgatcgttggcaacatccataatcttcagtcctggctgccgcaggaactggcacaggctatcgactacgttaagcagcacgttacggacgcaaccccgaccgggaagcatgatattgatggctcgcgcctgttttatctggtgtctgacgatatgacgcagccgttcgccgagcgccgcgccgagtatcacgcgcgctatctggatattcagatcgtgctgaaggggcaggaaggaatgaccttcagcaccctgccgaacggtacgccggataccgactggctggcggataaggacatcgcgtttttaccggcaggcgagcaggaaaaaacggtggtgctgagcgaaggggattttgtggtgttctatccgggggaagtgcataaaccgctgtgcgccgtaggcgaggccgcgccggtgcgtaaagtggtggtgaaactgctggtggcgtaatggtattgccgggtggcggctgcgcctgacccggcctacaacatcttcaacatcgatgttaaccgtaggcccggcaagcttgcgccgccgggcgatacatcactccgccagggtcgccaccatcaccgctttaatggtgtgcatacggttttccgcctgatcaaacaccacgctgtttgccgattcaaacacctcgtcggtgacttccatgccgccacgaaggccataggtctccgccatctgcttgccgagcgtggtctgatcgtcatgaaacgcgggcaggcagtgcaggaatttcacctgcgaattgccggtcagcgtcagcatctggcggttcacctggtagccgcgcagtagtgcaatgcgctccgcccacttctctttggcttcgcccatcgatacccagacgtcggtatagataaagtcagcgcctttcacgcccgcggcgacatcttccgtcagcgtgatattgccgccgtttttcaccgccagcgccgtgcactcggccaccaggctcgcgtccggccagcaggctttgggtgcgaccagacgcagatccagcccgaccagcgcggcggcttccagcatcgagttgcccatgttgttacgcgcatcaccggcatataccagcgtcatctcattaaaggctttgcccggcagatgctcctgcatggtgagcagatccgccagcaattgcgtcgggtggaattcgttggtcaggccgttccataccggcacgccagcatattctgccagcgtttcaacaacttcctgcccgaaaccccggtactgaatgccgtcgtacatgcgtcccagcacgcgggcggtatccttaattgattctttatgcccaatttgactaccggcagggccgagataggtgacgcgtgctccctggtcaaatgcggcaacttcgaaagagcatcgggtgcgggttgagtctttttcgaagatgagcgcgatgtttttaccagtaagctgctgtacttctttaccttttttcttatcggctttcagttgcgcggcgagcgccagcagggtgtggatttcagcgggtgtaaaatcgagcagtttaagaaagtgcttccggaataatgcagacatatttccctcacatggcttaggccacttattgaattaaaattcactttatatgtgtaaatattcatttgcaaccctgtttaacaaatcttttcggtcaggagtggaggcattgtcagcggtgtgtgaaaataagagtatctgccgcacattatgaggaacgatccatggcaaacccggagcaactggaagagcaacgcgaagaaacgcgtttgattattgaagaactgctggaagacggcagcgatcctgacgcgctgtacaccatcgagcaccacctttccgctgacgatttcgaaacgctggagaaagtggcggtcgaggcgttcaaactgggttatgaagtcaccgagccggaagagctggaagtggaagaaggcgaagtggtgatctgctgtgacatcctcagcgaatccgcactcaaggcagagctgattgatgcgcaggttgagcaactgatgacgctggcagaaaaattcgacgttgaatacgacggctggggcacctactacgaggatcctaacggcgaagaaggcgacgacgatgaagatctgctggacgaagacgacgacggcgttcgccactaagtaaaagtgcggcagcgcctgctgccgtaccacctttcccgcaggcattcccaccaaaacgccctcaaatgcaccaatttctggcaggtgcgaccgaatccgatgttgcgtaacatacctctcctttttttcactataactttttaacaacctatacagagagtcaggatgaaactgtcacggatcgtcatatcccttatcgtcgtacttgttgtcgccactgccgtcggtttttttatcggttcccgtccctcgcaatccggactcaccgaggagcagaagtttgacgccgcgatggcgcaatttccctcctttacagtgctaaaagagcaggagccggagtactggtcgaagctgcgtggccgcgcgctggctatgcagaaagagggcaaaacggagcaacaaatcatcgacgtcatccagccggaaattttgcagatccagatctcgcgtctgcaatcggcgccggacgatcaggtggtgcgctatatgaaagtgaatatggagcagacggcggcgatccagaaggtgagtgacgatgactgctaccgcttcctgttcccgaacgtgaaaggcggtatcaatccgatgcgtgtactgtccaaagagatgctgacctaccgcgccaccgtggacgccgatatgatgcgttcggcatacggcgcgggcaaacacactgcgacgccgcaggagcgtgaacgcgcccagcaggatcttcaggccgttgccgccacgctggtgaaaaaatatggcgatgatgtggccatcttgtctgagccgcagaagggcgtgggcaaagagaagctgacctgcgatatggtggaagagatgtggagcaatgtgctggcgctaccggctgataaagccgcgggtattgtgcgttttatgatggcgcaataacgcctctctggtggccctcccgaaaagggagggcctgttaacgagtattacaacgctttcagcatgcggacttcgcagtccacgtgcccggtgcagcccagcggcgcgtcgatatgcgcaaagcccaggcgctcatagagcgcaatggcgtctttaaggaaggccgtggtttcgaggtagcagcgggtaaaaccctgctcacgggcgaaatccagggcagaaagggcgagctggcgcgccaggcctttaccgcgaatgcccggcaggaaatacattttttgcagttcgcaaatgtccggatcgctacaggtcagcggcgcgataccaccgccgcccattacctggccgtcctgctccaccacccagtaagcatggcgtggctggctgtagagctggaacaacgcgtccagattcggatcggccacggtgtagcctttatccgccgtgagtccgaattcagccgaaacctcgcggatcacgcgggcaatggccggattatcattttcctggagagggcgaagccgtaattcgcctgtcatactgagtgcattattctgcatgggataacctggaaacgtgggacagtaaaagtctttggacaagcccccactataaaacagacctcgcgggatgaaaaataaaagcctgcattaacacttttccattttattgccggtatacggcaatgaagttcagcgcagtacattgtgctgcgtgacgttaattcccccttgtaataagggttttaatcattcatttcaggacgaaaaagtatggattccttaactaaaacacagcgtcatcaaatcaagtttcacggggatggcggtaactattttacaatatggctggtgaatatcttcttgtctgttattacccttggcatatattccgcctgggcgaaagtcagaacctaccgttatttttatggcaataccgagctggcgggcgatcgctttgattatcatgcccgtccgatgcaaattctggtcggtcgtatcatcgcctttgttggcatcgttattttctacctttgtttcatggcaagtgaagtgctgggaatggtgatcatgctggcgtttattgcgttactgccgtggattattatccgcagctggcgcttcaatgccattatgtccagctaccgcggcgtgcgttttaactacctctgccgcgttggtcgcgcctactgggtattcctcggcttcccgctgctggctttcgcggcgctgattgttatcgtgtcgctggtgaattttttcaccaacccgatgctgggtattctgctgatggtggtgatttttgtgccgggcgcgatcctcattcaggggattaattccgcgctgacttacgacctctacgtgaacaaccttttctttggcgatgccgcgttcaaaggcgacatgaataaagacgcctttgtcaaaatggcctttaaagccgcgctctttgtggtgccggtgctgattattcttgggctgatcttcgccaaaatgttttactccattatgcaggcgagcgtctacggtggttctgaagatgcgatcgccatgatggtgctcagcaatataggcctgattattctggcttatgtggtggcgctggcgggtggcatgatggcggcggcctggctgattgtggcgcaccgtaattacgtggcaaatcagaccacgctgaacggcggcgcgctgcgtctgcactccagcatgaaattcacctcctacctcggcctgctgttcaccaatgcgctgatcgttatcttctctttaggcattgcctcgccgtttgctcatgtgcgtcatgcgcgttacctgctgcaaacgctggaggtggaaggggatctggatctgctgaccgtacgcgcccacggtgaacaggctcccgctgccgtgacggaagagctggtgcaggcgctggatatcaatgtcgggctgtgatctcagcggcttttatcagtatcccggtcgggctgcccgtgaggcggcccgtctgacgttgcatgacggggcggtgacgctgcaccgggatagcggcgacgagacgtacccgctggcggcgctgaccgtgtcagaggcgctgggagatattccgttgtcgctcacctttgccgacggcggccgttttgcgccgggtgacgataaggcgtttcgccagtggtatttccgccaccggcgtccggggctggtccaccgcttagagcagcacaaacgcggcgtggtggcgatgctgctcgccaccgtgctggtgggggtattttacgtctgggtgctgctgccgtggctgagcggcgttatcgcccatcaattaccggtgagcattgagcagcagcttggccgctacagcgccgcttatctggaagagcaggggctgacggagagcaaactgagtactgcgcgccagcagcagttgcagacgctgttccggacggtgatcccgcaggatatgcgcgatcagacgggcctgcgcctgcgcatcatgcatttcccgctcggggcgaatgcgttaatgctgccggatggcaccatgatgctcagcgaccagctggtgcggctggcgaaaagcgacgatgcgctggccgccgtgatgctgcatgagatcggccattaccgttaccggcactccatgcagatggtggtgcgctcgtcgctgatctccatcaccctgatgtgggtgatgggcgacgtcagcggcatcggcgataccctgttgcagtcagcggtgctggtgaacgagatgcgcttctcacgcagtatggagagcgaagcggatcgctttgcgctggcggaaatgcagcgccagggacgaccgttaagcgcgatgctgcaaattttcaccgcgctgggcgagcagggcaaggatgacgacaagtgggcgatcccggactggctcagcacgcatccggcgatgcaggagcggctggaaagcatccgcaacgccacgcaataaaaggcataaaaaaaccgggcgcagcggcccggttttttattcacgatgaaccgcttacagcgcggcgatcacgccctgctgctcaatcagcttcgctttggcctgggcgaatccgtccagacgctcgcgctctttggcaaccacggcttccggcgcgcgcgccacaaaaccttcgttacccagtttgctttcgattttcgcgatttcctgctcgatcttcgccacttctttcgccagacgctccagctcagcggctttgtccaccagaccggccattgggatcagcagctcagcgccgtcaacgattttggtgaccgataccggccctttgtcgtcggcaggcagcacggtaatgctctccagacgcgccagggtttgcaggaagctgcggttttccgtcacgcgacggataacctcatcgctgcaaccgcgcagcagcagcgccagcggtttggcaggggagaggttcatctcagcgcgaatattacgcaccgcgacgatcgcctgtttcagccactcggtatccgccagcgccgcgtcgtctgccagcgccgcgtcaaactgcgggaagggttgcagcatgatggtgtcggcggtaatgcctttcagcactttcacgcgctgccagatggtttcggtgatgaacggaataatcgggtgcgccagacgcagcagaccttccagcaccgtcaccagcgtattacgcgtgccgcgcagttccgcttcggaaccgccgttcattaccggcttggtcagctccagataccagtcgcagaactggttccaggtgaactcgtacagaatgcccgcggcaatatcaaagcggtagctgtccagcgcttcacggtaggctttcaccgtacggttgaactcggcgaggatccagcgatccgccagcgacagcgtcagttcgccgccattgaagccacaatcctgatcttcggtgttcatcagcacaaagcggctggcgttccacagtttgttacagaagttacggtaaccttccaggcgcttcatgtcccagttgatgtcgcggccggtcgaggccagcgccgccagggtgaaacgcagggcgtcggtaccgtgcggctcgatgccgtccgggaactgtttctcggtacgcttggcgattttttccgccagctgcggctgcatcatgttgccggtgcgtttttccagcagatccggcagggagatgccgtccaccatatccagcgggtcaatgacgttacccttggatttggacatcttctggccttcgtcatcgcggataagaccggtcatgtagacggttttaaacggtacctgcggcttgccgttttcatctttgatgaagtgcatggtcatcatgatcatgcgcgcgatccagaagaagataatgtcgaagccggacaccatcaccgaggtcgggtggaactggcgcagcgcgtcagtgttttccggccagccgagggtggagaaggtccagagcgcggaggagaaccaggtgtccagcacgtcttcgtcctggcgcagggcaacgttcgcagagaggttgttttcgctgcgcacttcttcttcgctgcggccaacgtagacgttgccgtcgttgtcgtaccatgccggaatacggtgaccccaccacagctggcgggagatacaccagtcctgaatgtcgcgcatccaggagaagtacatgttttcgtactgcttcggcacaaactggatatcgccgttttctactgcttccaccgccggtttcgccagcacgtccgcacggacataccactggtcggtcagcatcggctcgatcaccacgccgccacggtcgccgtaaggcacggtcaggtcgtgcggtttgatctcttccagcaggccgagggcgtcaaccgccgccactaccgctttacgggcagcaaaacgttccagcttctggaactgcgccgggatcgcgcctgagtaaacgtcggattcgttgcctttggtgtcatacacttcggccacgtcacggatgtcgccgtcaaaggtcagaatgttgatcatcggcagctggtgacgacgacccacttcgtagtcgttaaaatcgtgcgccggggtgatcttcacgcagccggtgcctttggtcatgtccgcgtgctcatcgccgacgatcgggatgcgacgatccaccagcggcagcatgacgaatttgccgatcagatctttataacgcggatcctccgggttaaccgccacgccggtatcgcccagcagggtttccggacgggtagtggcgaccaccaggtaatctttgccgtcggcggttttcgcgccgtcagccagcggatagcggatgtgccacatggagcctttcgactcgcggttttccacttccagatcggaaatcgcggtgcgcagtttcggatcccagttcaccaggcgcttaccgcggtaaatcagatcttctttatacaggcgcacgaagacttcttttacggcgttggacaggccttcgtccatggtgaagcgctcgcgctcccagtccacggagttaccgaggcggcgcatctgacgggtaatggtgccgccggattccgctttccactgccagattttgtcgataaaggcgtcgcggccgtaatcgtggcgggttttaccttcttcggcggcaattttgcgctcaaccaccatctgcgtggcgataccggcgtggtcggtacccacctgccacagggtatttttgccctgcatacgctggtagcggatcagggtatccatgatggtttgctggaaggcgtgacccatatgcaaactgccggtgacgttcggcggcgggatcatgatgcagaagctttcctggctttcatcgccattcggtttgaaatagccctgctgctcccagtgctcgtaaagcggctgttcgatatcttgtgggttatatgtcttttccattatttccaggttgccgtattcaggttaaaaccagccaggcgataggctttatagcgctcgcgagccagttgtttcaaagtttcttcgtaggggacgaagtctaccacttctgtgaaagcggtggcaaaatctgcaaagttaacgcgtaaagcgattaacagatcgcgcgggctgctgttgcgtttttgcggccaggcgatctccaccggcgcgccgccccgtggtccttcacccgccagattatgcggcacaaaactctccgccggacgcgcccacagggcctcgtcaagacggatcgcctgttgctcatcctcgcaggcgatcagcacgcgcttgccgttgcgccaacgttccgcggcaatttcacacaccagttgttcaacggcgctgaggccatctgtggtgtcgtcattgtccagaaggtagaacgtcgcgtttttcatgatatggggcttctttgatggatttaaatgtgaagccgggtggcgcacgcttacccggcctacggttgagtggcgtgtaggccgggtaaggcgaagccgccacccggcactttacatcactcgtcgccgttaaaacccgcgcgattgagcaggaactgcgacagcagcgccaccggacgaccggtcgcgcctttagctttgccggagcgccatgcggtgccggcgatatccaggtgcgcccagttatatttacgggtgaagcgcgccaggaagcagcccgcggtgatagcgccgccaggacggccgccaatattcgccatatcggcaaaattagattccagctgttcctggaactcatcggccatcggcagacgccacgcgcggtcgcccgcctgttcggaggcgctgatcagttcgtgcgccagcggattgtggttcgataacagaccggtgatgtgatgacccagcgcgatgacacaggcgccggtgagggtcgccacgtcgatcaccgcttccggatcaaaacgttcaacgtaggtcagcacgtcgcacagcaccagacggccttcggcgtcggtattcaggacttccaccgtctgaccggacatggtggtcagtacatcacccggacgataagcgcgcccgccaggcatgttttcacagcccgccagcacgcccacgacgttaatcggcagctggagttccgccaccatccgcatgacgccgtacaccgccgccgcgccgcacatgtcgtacttcatctcgtccatgccttcggcaggtttgatggagataccgccggagtcaaaggtcaggcctttacccaccagcacaatcggacgcgcgtcttcgtcgctgctgcctttgtattcgataacggacatcagggattcattctgcgaaccctgaccgaccgccaaataggagtgcatacccagctcgcgcatctgctgctcgccgatcacgcgggtgacgacgttctggctgaaggagtccgccagctggcgcgcctgggaagccagataaccggcattacagatgtttggcggcatattgccgagatctttcgccgctttaataccggcggcaatcgccagaccgtgctgaatagcgcgttcgccgctggtcagttcacggcgggtcggcacgttgaacaccattttacgcagtggacggcgcggctcgctttttgtggttttcagctgatcgaagctgtacagcgtctcttttgccgtctccaccgcctggcgtactttccagtacgtattgcggcctttaacgtgcagttcggtcaggaagcagaccgcttccatggagccggtatcattcagggtatttatcgttttctgaataacctgcttatactgacgctcatccagctcacgctctttgccacagccgatgagcagaatacgttcggaaagcacattaggaacgtggtgaagcaataacgtttgtcccggtttgccttccagttcgccgcgacgcagcagcgcgctgatatagccatcgcttattttatcgagttgttcggcgatgggagaaagtcggcgtggttcaaatacgccaacaacgatgcaggcactccgctgtttctccgggctaccgctttttacactgaactccatgcactacgctcctgaatcttaaagacaacagccatggctacggatagaattgcaagctttcgtaactcatgtccgctgttgcggtgacttcgtgttaatcttaacgttattacggttcaacacgtcagaacttattctaaaccgcgaatccgctgagttttgttatcttagcgatgatttcaacgactcaagagaataaatgacgtttaagccatgaaacaagcgattttcctgcaaaaaacgggtttttacgggcgtatttaaagtgataatcataagatatttggtgcgggagacgctcaaaagccagttggcgatcctattcatcctgcttctgattttcttctgtcagaagctggtcaggatcctcggcgcggcggtggacggtgagatcccgacaaacctggtgctctctttactgggcttaggcgtgcctgaaatggcgcagctgatcctgccgctcagcctgttcctcgggctgttaatgacgttgggtaaactctacaccgacagcgaaattacggtgatgcatgcctgcggcctgggcaaggccgtgctggtgaaagccgcgatgatcctcgcgctgctgaccggtatcgtggcggcggttaacgtcatgtgggccgggccgtggtcggcgcgtcatcaggatgaggtgctggcggaagccaaagccaaccctggcatggcggcgctggcgcagggccagttccagcaagccaccgacggcaactccgtactctttattgaaagcgtggacggcagccgctttaacgacgtcttccttgcgcagatccgcccgaaaggcaatgcccgcccgtcagtggtggtggcggattccggcgagctgtcgcagaaaaaagatggctcgcaggtagtgacgcttaataagggcacgcgctttgaaggcacggcgatgctgcgcgacttccgtatcaccgacttccaggactatcaggcgattatcggccatcaggccgtggcgctggatccggacgataccgagcagatggacatgcgtacgctgctcaacaccgataacaaacgtgccaacgccgagctgcactggcgcttaacgctgatcttcaccgtctttatgatggcgctgatggtggtgccgctgtcagtggttaacccgcgtcagggccgcgtgttgtcgatgctgcccgccatgctgctctatctggtgttcttcctgctgcaaacctcgctgaagtcgaacgcggcgaaagggcgaatcgatccgctgatctggatgtgggccgtcaacctgctgtatctggcgctggcgattggtctgaacctttgggacacggtgccgatgcgccgtctgcgcgcccgtttcacgcgtaaaggagcggtataatgcaggcatttcgcgtactcgaccgctatatcggtaaaaccattttcaccaccatcatgatgacactgttcatgctggtgtcgctttccgccattatcaaatttgtcgaccagctcaagcgcgccgggcagggcagctatgacgcgctgggcgcgggcatgtataccgtgctcagtatcccgaaagatattcagatcttcttcccgatggcggcgttgttaggcgcgctgctggggctggggatgctggcgcagcgcagcgagctggtggtgatgcaggcctctggcttcacccgcatgcaggtggcgctgtcagtgatgaaaaccgctatcccgctggtgctgctgaccatggccatcggcgaatgggtcgccccgcagggcgagcagatggcgcgtaactaccgcgcgcagcagctttacggcggctcgctgctttccacccagcagggcttatgggcgaaagacggcaacaactttgtttatattgagcgcgtcaccggcgatgcctcccttggcggcgtcagcatctatggctttaacgatcagcgtcgtttgcagtcggtgcgttacgcggcttccgccactttcgatcccaatgccaaagtgtggcgtttatcgcaggtggatgaatctaatctgagcgatccgaaacaggttaccggctcgcagacggtgagcggcacctggaaaactaacctgacgccggacaagctgggcgtggtggcgttggatccggatgcgctgtcgatcaccggcctgcgggattatgtgaaatacctcaagtccagcggccaggattccgggcgctatgaactgaacatgtggagcaagatcttccagccgctgtcggtggcggtgatgatgctgatggcgctgtcgtttatctttggcccgctgcgcagcgtgccgatgggcgtgcgtgtggtgaccggtatcagcttcggcttcgtgttctatgtactggatcagatcttcggcccgctgaccctggtgtacggcatcccgccgattatcggcgcgctgctgcccagcgcctcattctttgccatcagtctgtggctgatgctgcggcgttcctgataagtcatcccctctccaccctggagaggggacatttcccccccgataattctgtactttgcgacgttctctgctacgcagactatgctatgcatacggttaactaaattatcaggtagttatgtccagatttttctttaatgaccgcaagcagctggtcaacgacgccattgaaggccttgtcatctccgcccctcacgccaaccttgtccgccttgatattgatcctgccatccgtgtggtcgcccgcagcgactggagtaaaagccgtgtggcggtgatctccggcgggggctccggccacgaaccggcccatgcgggctttgtcggcaaagggatgctcaccgccgccgtttgcggcgatgtctttgcctcgccaagcgtggatgcggtactgaacgccattgtcgcagtcaccggcgatcgcggctgtctgcttattgtcaaaaactacaccggcgaccgcctgaacttcggcctcgcggcggaaaaagccaagcgctacggcctgaaagtggaaatggtgatcgtcgccgatgacatcgcgctgccggacaacaaacagccgcgcggcatcgccggtacggcgctggtacataaagtggcgggtttcgccgctgaacagggcaaatccctcagcgaagtgcgcgacctggcgcagcaggcctgtgacaacgtctggagcctcggactggcgatggaaacctgcaacctgccgggcagcgatggcgaagaagagaaccgcattcagcgcggtcaggtggagctgggtctcggcattcatggcgaacccggtgccaccacggtggactcgcacaacagcaaaaaacttattgataccctggttggcccgttaaaagagaaggcgggcaatgaccgcgtggcggtgctgatcaacaacctcggcggcgtctccgcgctggaaatggcgctgctcaccaaagagctggcgcactcggcattaaaagatcaaatcgcctatctggtcggccccgcgccgctggtcagctcgctggatatgaaagggttctcgctgtcgctgctgcgtctgaatgacacctttgaacaggcgctgtgcgctgatgtcgagaccgtcggctggcagaaaccggtggccttcgcgccgatgcgcaccgtcagccacaacgccattcacgacagcctggaaattcagccctctgataacccgcaggtgaaggcgctggtgaaaaccgccaccgacacgctgattaaccttgagaaccgcctgaacgcactggacgccaaagtgggcgacggcgataccggctcgacctttgccgaaggggcgcgggatgtggcgcaactgctggcggacggcaagctgccgcttaacaacaccgcgcagctgctgcaactggtgggcgaacgcctggcgacggtgatgggcggctccagcggcgtgctgatgtcgatctttttcaccgccgccggacaggcgatccacgacgggcaaccgctgccggaagcactgttaaaagggctgaagcagatgaagcattatggtggtgccgatctgggcgaccgcacgctgattgacgcgctgcaaccggcgctggaagcgctgcgcgatcacgatctgatggcagccattagtgcggcgaaaaagggcgcagaagctaccgcatcgatgcaaaaagcgggggcgggacgctcgtcttacgtcaaccgcgaaaacctggaaggggtgaccgatccgggcgcggtcgcagtggctgaagtctttgctgctctgaagaaggtctgaatacgcaggcccggcaagctacgcgccgccgggcgttttaccctttaaaaatccgcttttaacaccacgcgataacgggctttgccgtcacgcacatgttgcagcgcttcattaatttttgacatcgggaacagctcggtggtcggtgccacctgcgcacgaccggcaaatttcatcagcttacgcagttcgtacggcgtacctgtggcagagccggagatgctgcggtcgccgccaatcagcgtaaacgccggcaccggcagcggtttcagcaccgcgccaacggtgtggaagttgccgccataggccagggcttcaaagtacggctgccattccagatcgacgttaacggtattgatgatcagatcaaactgaccggccagcgctttcagggcttccggatcgcggctgttcaccactttatctgcgccaaagccgcgcacttctgcttctttcgccgggttggagctgaacgccgtcacttcgcagcccatggcgcgcagcagtttaatggcgatatggcccagaccgccgataccgatcacgccgacgcggctggtagcggtgacatggtgcatcagcagcggtttgaataccgtgataccgccgcacagcagcgggcctgcggtttcaatatcaatgctgtccggcagcgggatcacccattgccagtcggcgcgaattttatcggcaaaaccgccacggtttaaaatggtcggcaccgcgccttccagacagttgatctggttgccgctgatacaggcatcgcagtgcccgcagctgcgcgccgtccagccaatacccacgcgctggcccactttcagacccttgtcctgcgcatcgcggccaagggccaccacgcggccaatcacttcatgaccggcaaccagcgggtactgcgacatgccccactcgttatcgatcatggataaatcagagtggcagataccgcagtaatcaacctgaacttcaacgtcagccggcagcagttcacccgcatcaaattcatgtagttccagatcggcaccggcctcaggggcggcgtaactttttatgatgctcatcacaatttccttcggttggcattgattagaaagaagtgtagagcattccgtaaggggcgacttagcggaagagggcattcagctaagtcgtcttatacttcatgctgatgaacagtgaccggagaacctaatgaccttacgcgcggcgatagtgttgctgacgggcgggctgccttttttcgcctcagcccataactttgtggaaggggaacgtgtgccgccggtgggggtggcagatcgcggcgagttgcagcttcagcaggaggcgatccgctatcaggtgtggaacagcgcgcgcctcggtggaaaagtgggcgtggtgctgcatatggcagggcgactctccgccaaagatcagaacgccgcgctgatcgacgctatcggcaaagccgggctgcccgccagccggtttgcggtcaccaccatcgtcaataccgatgacgccattcccggcagcgcgctgttcgtgcggcgcagtctggaggagagcaaacgggaaaccccggcggcgcagtttgtggtggacgatcgcggctcggtactccgcgcctggcaactgcaaccgggcggttccgccgtggtggtactggataagagcggacgggtgcgcttcgccaaagacggcgcgctgtccgctgcggaggtggatcaggtgatggcgctgctgcgggaactgctggcgtagtcgctcattgttaaagcaaggtaaatagttgtgatgaaggcgttgcgtaaaagcaaatatctgtagagtgcgctacgcttttcagacaaagcaggatgcaaataaacaggcaagcggctgttcaggctgcaaaagttcctggtcagattatgacggctcgatggcagccgtcacatgcgccattcgcatcataccgccacgacgaggaaccatgaccgtaacgatgaaggttaacgccgataactgcctgaaccatgaagatgagttacaggcgctgcgcgaggcgctgcaaatccgcctcgatcagctgttgcctgcgggccagcagcaggatctggtctatacggcgatgcgcgaaggcacgctggtggcgggcaaacgggtacgcccgttgctgctggtgctggcagcgcgcgacctcggctgtcatgccgatcagccaggcctgctcgatctcgcctgcgcggtggagatggtgcacgccgcgtcgctgatgctcgacgatatcccctgtatggacaatgcgctgctgcgtcgcggccgcccgacgatccaccgccagtatggcgaaaacgtcgctatcctcgccgccgtggcgctgctcagccgcgcctttggcgtggtggcggaagcccagtcgctgtcgcctgcctgcaaaaccctggcggtggcggaactctccaccgccgtcgggttacagggactggtacaggggcagtatctcgatctgcacgagggtgccgggacgcgcagcgccgaagcgatcctgctcgccaatgaactgaaaaccagccgtctgttcgacgccacgctgcaaatggcggcgatcgtcgccgatgccccgccgcaggcgcgtcagcggttgcgctgctttgcgcaggatctggggcaggcgttccagttgctggacgatctggccgacggcctgaacggcaccggcaaagatgtgaataaagatcacggcaaatcgacgctggtggcgatgctcggcgcggaagcggtgcatcagcggctgcgcgatcatctgcgcagcgcggatgaacatctcaccagcgcctgtcagcgcggtgtctccacgcggcgctttatgcacgcctggttcgacaaacagatggcgctgttcggctaacacgttttatctcaggacgccacatcgactggagcggcaatgaaggacagggaactgactcaacgcaaaaacgatcatctggatatcgtgctggatccggcgcgggcgctgaaaaagcgcggcaccggttttgccgactggcgttttgaacactgtgcgatgccggagctggatctggacgccatcgatttaagcaccacgctgttcggcagaacgctgcgtgcgccgctgctgataagctcgatgaccggcggcgccagccgcgccagggaaattaaccgccatctggcggaagcggcgcaggcgctcgggctggcgatgggcgtcggctcccagcgtgtggcgctggaaagcgaagataactgggggctgacgcgcgaactgcgccgtgccgcgccggatattccgctgctggcgaacctgggcgcggcgcagattgccgcccaccatggcatcgattacgcccgccgcgcggtggatatgatcgaggcggacgcgctgattattcatctcaaccccttacaggaagccttgcagggcggcggcgaccgcgactggcgcggcgtgctggcggcgatcgcccgcacggtgaaagcgctgccggtgccggtggtggtgaaagaggtcggcgcagggatttccgtgccggtggcccgccagctggctgatgcgggggtggcgatgctggacgtcgccggttccggcggcaccagctgggcagcggtggagggcgaacgcgccgcgacgccgcatgaccgcgccgtggcgatggcctttgccgactggggcatccccaccgctcgcgcattgcgcgatctgcatcaggcgctgccgcagatgccgcttatcgcctccggcggcgtcagcgacggcatcgacgttgcgcgcgccatcgcgctgggcgcgaccctcgcaggccaggccgcaggggtgctcggctgcgccactgcctccggcgacgcggtgatcgcccattttcagatcatcatcgatcagctgcgggtcgcctgtttctgtaccggcagcgccagcctgagcgcgctgcggcaggccagactggtgcgcgtcggggatgaggaatgagccattacgcggttatcgcgccaccgctctacagtcacgtgcgcgcgctggaagcgctggcgcaggcgttaatcgcccgcggccatcgcgtcacctttatgcagcaggcggaagcgcgcacgctgcttgacgacgcgcgcatcggtttttatccccttggcgaacgcagccatccccccggcagcctggcgcgcaccctggcgttaacggcgcacccgtcaggaccgggtatttttcggctgattgaagacatggcgaaaaccagcgacatgctctgccgtgagctgcccgccgcgctgcaacaggcgggtatcgacgggctgatcgtcgatcagatggaggcggcgggcgggctggtcgccgaagctctgggcctgccgttcgtctcggtcgcctgcgccttgccggtaaaccgtgagccgcatctgccgctgccggtgatgccctttaactacgccaccggtccacgcagccagaaactttatgccaccagcgagcgcatctatgactggctgatgcgccgccacagcgaggtgatcgcacgccatgcgcgcgcctttggccttggcgagcggcgatcgctgcacgactgtctgtcgccgctggcgcagatcagccagacgctgcctgcttttgattttccccgtcgccagctgcccgcgcactttcacgccgtcgggccgctgcgccacagccacgccgcgccggaggaggtacagacttccgcgcagccgctgatattcgcctcgctgggcacccttcaggggcaccgctacaggctgttccgcaccatcgcccgcgcctgccgccagctgaacgtccggctgcttatcgcccactgcggcggcctgaatgaggcgcaggaagcgcgactgcggcgctacggcgcggaggtgactgattttgccgatcagcctgccgtgctgcgccaggcgcaggcggtgatcacccacggcggactcaatacggtgatggacgcgatagagagcgccacgccgatcctaactatcccgctggcgttcgaccagccgggcgttgccgcgcgcgtggtttacagcggcattggccgccgcgcttcacgctttaccaccgcaggcgcgctggcgaaaaacctgaacgcgctgctcaacgacgcccgctaccgtcagcagctacgcctgatgcagacgcagcttgccggtgctggcggcgcgaccagcgcggcggaaatagtggaacaggcgctcaacagccgccacccgatcctggcggcctgcgcatgacgcagtacgatctgatcctcgtcggcggcgggctggccaacgggctgatcgcctggcggctgcgccagcgtcagccgcagctcaaagtgctgctgctggaggccggtgcagagccgggcggcaatcatacctggtcatttcatcacgaggatctcaccccgacgcagcacgcctggatagcaccgctggtggcgcaccgctggcccggctatgacgtgcgctttccggcgctgacccgccggttcgacggcggctatctgagcatcacctctgagcgcttcgcacttgagatggcgcaggcgctgggggatagcctgcgaaggcagacgccggtcagcgcgctgacgccccggacggtgacgctggcggacagcacggagcttcacgccggtgcggtgatcgacgggcgcggctatcagccgggcgaacatctgactattggcgcacaggcgtttctcgggcaggagtggcggctcagccagccgcacgggctgacgcgcccgctgctgatggacgccaccgtggatcaatcggcgggctatcgctttgtctatacgctgccgctctccgccgacagcctgctgattgaagatacccattacatcgatcgcgccacgcttggcgacgatcaggcgcgccagcatatcgtcgattacgcggcggcgcagggctgggcgctggagacgctggagcgggaagagcagggcaacctgccgatcaccctggcgggagactgtcgcgcgttctggcggcagaaggcgggccagccctgtagcggcctgcgcgccgggctgttccactccaccaccggctactccctgccgcaggcggcggcgctggcggatctgatcgctgcccagcgcgacctgtcgtccggcgcgctcttcgccctgacgcgggactacgcgcagcagcagtggcgtcgccagcgtttcttccgcgtgctcaatcgtatgctgtttcttgccggacgacctgaccgacgctggcaggtgatgcagcgtttttaccgacttaacccagggcttatcgcccgcttttacgccggtcagcttaccctggccgacaaagcgcggatcctgacgggcaaaccaccggtaccggtgggcgaagccctgcaggccgtactcaaacacactccccggctgcgagcgttcagtgatgaataaaacagtagtaataggcgctggtttcggcggcctggccttagcgatccgcctgcaggcggcaggcattcccacgcagctgctggagcagcgcgacaagcccggcggccgcgcctatgtttatcaggatcagggttttacttttgacgcaggtccgacggtgatcaccgatcccaccgccattgaagagctgttcacgctggcgggcaagcgcatggccgactatgtcgatctgctgccggtgacgcccttttaccgcctctgctgggagacgggccaggtctttgactatgacaacgatcaggcgcggctggaagagcagatccgccgctttaacccccgcgacgttgaaggctatcgccgctttctggcgtactcgcaggcggtatttaaagagggctatctgaagctcggcactgtgccttttctgtcgttccgcgatatggtgcgcgccggtccgcagctggcgcgtttgcaggcgtggcgcagcgtttacggcatggtgtcatcgtttatcgaagatgagcggctgcgcgaggcgttctccttccactccctgctggtgggcggcaaccccttcgccacctcatccatctacacgctgatccatgcgctggagcgcgaatggggcgtgtggttcgcccgcggcggcaccggcgcgctggtgcagggactggtgcggctgtttgaggatctcggcggcacgctggagctgaacgccgaagtcacccggctggaagcccgcggcaacgagatcggcgcggtgcagctggcagacgggcggcgcattgaggtggcggcagtcgcctccaacgccgatgtggtgcacacctacgaaaaactgctcggccatcatccggtgggtgcgtcccgcgccgcgtcgctgaagcgcaagcgcatgagcaactcgctgttcgtgctctattttggtcttaaccatcaccacagccagctggcgcaccacaccgtctgcttcgggccacgctataaggcgctgattgacgatatttttaaccgcgacgccctgtcggaagatttctcgctctacctgcatgccccctgcgtcaccgatccttctctggcgccgcccggctgcggcagctattacgtgctggcgccggtgccgcacctcggcactgccgatctcgactggaatgtggaagggccgcgcctgcgcgaccgcatcttcgcctatctggagcagcactacatgcccggcctgcgcgaccagctggtgacgcagcgcatgttcacgccctttgatttccgcgaccagcttggcgcgcatcatggctcggccttctccgtcgaacccatcctgcgccagagcgcctggttccgcccgcacaaccgcgacagccgcattcccaacctctaccttgtgggcgcgggcactcatccgggcgcgggcattcccggcgtgattggctcggcgaaagccaccgcagggctgatgctggaggcgctggcaccatgaacagcacgctgatggaacacgctaccgataccatggcggccggatcgaaaagcttcaataccgccgcaaagctgtttgacgcgccgacccgccgcagcgccctgatgctctacgcctggtgccgctactgcgacgatgtgatcgacggccaggtactgggctttcgggatgcctctgccgttaccggcagcggcacgcagcggctggcgatgctgagaaccgagacggagcgggcgtacgcgggcgcaccgatgcaggagcctgctttcgccgcctttcaggaagtggcgacacgccacgctattccgccacagctggcgttcgatcatctggaaggcttcgccatggacgtgcgcgacacccactatgagacgttcggggatacgctacgctactgctatcacgtggcgggcgtggtggggctgatgatggcgcgggtgatgggcgtgcgcaacgaggcggtgctggatcgcgcctgcgatctggggctggcctttcagctgaccaacatcgcgcgggatattgtggaggatgctgaagccgggcgctgttacttaccggcgcagtggctggcggaggagggcatcgaacgcgaacagctcgccgatcccgcgaaccgtgagaagctggcgcggctggcggcgcggctggtggacgccgccgaaccttactacgcctcggcacgcgcgggcctcgccggtttgccgctgcgttccgcctgggcgatcgcctcggcccatggggtgtaccgggagattggcgtaaaggtgaaagctgccggcccccgcgcctgggatcggcggcagggcaccagcaagggggagaaaatcgcgctgctgctcaagggcgcagcgcaggcggtcagctctcgcgccgcgtcgacgtcgccgcgttcttctgcgctgtggcagcgtccgcggcatgacgatcgcgcggtatagccttctcgccctgcggcggtctgccgttacggctgcgcaggatcgcctggagctttgagaccggcggcgcatagagaaagccgaaggagacgcagtcctctttgccacgcaccgcatgatgcaggcgatgcgccatatagagacgtttcaggtagccgcggcgaggaatatagcgaaacggccagcgctgatgcaccagcccgtcatgcaccataaaataaatggcgccgtagagcgtcatgcctgcgccgatccactggagcggccagacgccggacgtgccgacagcgatcagcgctatcgccagcacggcgaacaccacggcatagagatcgttgacttcaaaccagccggtgcgcggttcatggtgtgaaagatgccagccccatccccatccatgcatgatgtatttatgcgccagcgtcgccacgatctccattgcggcgacggtcgtcagcacaatcagggtgttccacagcacgagcatcgtgactccttgttttgagatgatgcagagtatagcaagggagtcaccatgctgccgggcggatgggagacgggcagggctaaggcgaaattttcggcacttagcgcacgctacggacaattgaggttgcgaaggtggccggtaagggtataatcctcaacgttttccgcatacctttccgtgccggagtggcgaaatcggtagacgcagttgattcaaaatcaaccgtagaaatacgtgccggttcgagtccggccttcggcaccatcggaatgctaattaagtcgcctaagggcggctttttttgtgcaaaattccagcagttatcacttttttatcatctctcccacccatatttgatgggctatgaattgtacaattcatctaattttgggcacatcagtatttagagctgaacttcaatgtgtgtgcagttaagtcaaaatatagcattcatatcttcatcattttcgggttatgagacgccaaatacattcagaacttagaaaggtagtagagatagcgtactcatttatataaaatggttattatttttcctcagagaccatgcggttatgagcgcaatcacattacgtaaagcgttgggtgtactggcgaagtcttcttcgttttcagtgactacggtgactcaacgagaaagagatgagtatgatcagttaaaagaccaactgtttgtaaagcaagaaattgaatctgaattgcaacgtcatctggatgttgcgaaacctggcgaaatcatttttttatgcggcagtagcggggatggcaagtcagaaattttaactcggtgtaaggctgatccacgctatcagcgcaaatttagatttcatcttgatgccacacatagcttttctccccgacaatcggctatcgaagcattgaatgagctttttagcgagcacgatcaacaatcactgccgttactaattggtatcaatactggcatgcttgctaattttgcccgagaaggcgatgagaagcacacagcacttaggtcagcgattgatttatttttatcagttcaacagcacgcaagcagaccttaccgtaacggtaattgttctttttttgactttgaacattatccaaaattccagtttgatgaaagcggaaattattcaccatttatcaaaagtttgataaacaatcttacttgtgatgatgatggcaatttatttcaatttattttaagccgtgatgagcaaactaatcccgatctgaaagaggtggcaaattttaggctacttagcatgccaggtgttcaggatgtattaataacacagctgtttaaagcccggttaattaaggatcagtttgtcacgacaagaacattgctggactttttgcatcatttacttacggggactggttatttgtttgataacctcttcactggtgaagaaaatgatcttattagaaaggtttctgattttgatcctgcgcgcttgcatacatatgaacttgatcagttcattttacgctatgagcttagactagttgatgccgacttagatgaatttttgtccgcacttgagagtttacatattaaattcgatcgccattatgccaagcctggagatgctgcttccttgattcggcttttttggttacttcagcatgagtcattaggaaataattatcataagagattctcaagattctttaacgaaaccctctttgaacgctattcagagatatggcatcagcataaaaattacacggcaaatccagaacagaaaaagacacttaatcgtttttacgcttttgaacttattgctggtattcaacgatatgctaatcgtaaagctccagaattaaatatgcagaaagaggagttctttctgggagagtttggtggagttaaaataaccgcgccggtagaagtaaaaccagattgggacgctctacgtaataaacatacggcacattcaactggctttgatgtttatctcaaagtaggtgaaacctcgctgccgcctgttcatattggactcaatctttttgagttattgcataaattgaacaatggctatcggccgaataaatatgataaaaatgcgatagtattgcttgatgagcttgttgaacttattacagatcaggctaaatctagccgcgaaattaaattttacgctagccgatcgcgagttttccgcgctaaagccgatgacgacatgatcaccattagcggtatggagggatagtatggtgtaccctatcgcatcaactttaaaagttggtaataatcaggtagatagctacttgcctgttcgcaacaagaacaatgaaatcaattggcaatttgttactgggttagtgcttagctatgcgctaaaacgtaaaatagaagcctacgatccagatcaatttcgtgatgattgtaaaagtcacttacaaacactgcttgatgagccagaattttggtcggtgcttgagcggatgtacttttccagccaggatatcttccgtgtttcgccgctatttttattgtttcacgctcaattttctggtgaaaaactgatcgcaggttcaacggctgataaacgccttggaacattgttctctaatttaatgggcaatttcagtcttacttacccgattgaggacaaactaaatttcattgagcaacaaatcttgaataaactcaatgaaaaaataaaactgctcgggaaaggtccatttgccgaagagcaaccttatctcccttatatggcattatgctttcaggctgacctggagtttctggcggagcacccgcagtatctcttacaagaattaactaatacactgcgtttgtacgcttttagctggtgtgctcaattagcacttaatttggacagttggcaagatggcgagccacagagcaagtctttatttttcattctggacagtgaaaaagccagctctgaacgagaaaaagttaaacgatatggatataagttatttgctagccagagtgaaaagctttttccagtactttctgcactagaaattttgcagtggggaaaaggggagaaaaaacgtcctctttggcaaatttatcaagatagtctgaataattcagagtcttcttcacaagtattacatcatctaaataactatttacatgattttatcgaggatcgcggtcttgagcttcgtgaacctgctaccagtctggagcatgctttcaagcaactaattactgtcgccattgagcaatttcagggtaaaaagtctgatcgtgcaacagtaaaccgaaaatacgttaatgaattagaaaatgaaatatgcattgacttcattcaggtaagaggtcgagcaggtaaagtgttagttttaaatcaggaccgtttattattactgactaaccttacggttggtaaaaatgacaaactccgcctacatgaactgttgcgcggttttgaacagcgcggtttttatctggataaccagtcggcgcaaacgctggtggcgttttatgaacgcatgggaaatgtagagcgaatgagtgatagtggagatgccgtatatgtccgtaaaacagtatgaaacttatctggcggaaacctttattgaatgggttggcggcattatccaggcaggtgaacgttaccagttcaaatgtcccgatcctggtaatgctttaaaactttggcaagcttttatcgatcttgcaggcgaaaatcaacttgagtctgagccgggacaacacctggcatatgtctcttgcgatagtgtgatgctgattcctgtcttgcatggcgctgacgctcctgcattcacggaaaattatatttcccatctgcgagatgtggttgcaggccgcagtggagctttttcccaaacagcactgttgatcatacataacagtatgctcgatacattgattaatagtacgaaagatgtggctgctccagatgcaatctggtacccgcaaacctttagccatcagcttgaaaaactcattacatctgataataagcgtgctgaattgacccgctgtttgctggaggatcaactggcgacggtactggatgaaggcgcgaccgtatttggtttctcgtcgctgtatcgcttgctggatgatggtaatctggatttctccgagcttcatctttttaaagatgatgaacttctgaactatagccagaagcagctacgcactcgactgaatgaaaaccggaaattatatcgccagattgaagacagtgttgaacgctacggtgggcagctggagaatgtgctgcctgagtttagtacaaaattcattcaggagcatttttacgacaaagatgactggcgtgagctcgatttctccgattataggaaagagaaagaacagaataatgaacaaaaactggtgctggagaacgtttccgtcgaaaacggcgagatttggcaacgggcgaaaagcgccagtaaagcaggaaaacgtgacatcagcctgctggtgcaggtacagccaggacaatcaaaggctgagctggagttcagttttcagggtaatgatcttcaggataaccagataaagattgcccataatcgccagttaaagaatgcacctttctggcgcaccagtcgggcaggcggcaagacttcccgcattatggcgtcggtgccttttgacgggcatccctgcttttttagtctcgaattgaccaaccgtaataattcagccgaagagtataaatttcgcctgttgttggtcgagcaggggcaattctggctaaacgatattcagcactgctaccgcgttgagccaggtaaagaccaaataaccctgcaactagaagataacacgctgcgtattgccgagtctggcaacctaacctgtatgttggatgacgagagcgaagacatcgactgccagcattatgctcaggtggattttgagacgctggcaaatcaaagtgacctagttcagtttgcgatcgtttccggtgattcccgtctgtcgtttaacatcgaggggccgggagcagaagaagggctaacgctgccgctgctttttgaccaaagtcgtttcaataagttgttcaaagaagagggcaatgcaacctggaaccgactaaaagggcgcatcattcttgataatactgaacacaaggtcgtcggtgtacgccagcagctgttgatactggaagcctcattaattgagcaacgtctgctgggtacgggaagtgacaatagcgagtttgcgctggatgaacttcttgccagttaccccgatctccataacgcctatgagcagttatttgcctactatcaacgtcatagcaccctggcgagtttggtgtcgtggtcaacggagtaccgcacgctggttagtaacattgttagtacgtttgaacaggcactacagcaaatcggtctgagcagagcgctgatagcacaggagaaacgtcttctgcatctgggggtctgccgcaatgatagccatgagcgcctctctccgctacatccactagtactggcctaccatttacaattggcagaaactatcgttgcggagacggaacagcacgattcggcttcatttgccacactaccggcgattactcttgatcgcctgatggtgtctggcttaatgccgtttgtttaccacagtgagcatgaatatgcgcaactacagccagtagaggaaaaccgcttctggattgatgtcgtcccccagcgccaggttagtcatgactacgttaagcgtctggtaaaagacaaactcaatgaattcactgacgcctacgctcgattgttccagaacgccggaaacgatgctttagttatcaatgccattaatcagggaaatgctaaagagctatttttagggttagtggaatattttaaacaggaaaaagagcacgctatttcggtgcatgtgaactgttacgacgaacgcttgctacccaatatgttcgatcactttgccgaaagtagcagctatgaacagcttaaaaacgatcttgatctaaacagcggcgcatggcgggcggaagctgatatgctgattgacttgctgcgcagccgattaacgtttagcaagtttgtcctgccatcagaaagtgagaaattggcctatgcgcacctggcttttttcaccaacacggcaccggtcgattgccgccaaatccgcattgaagatgcgtccagtggggtattatgtcatgggcttatcgccggagagggggctgagattcagggggatgcctactttaccgcatttggcctgcgtaatgtggatactgaatcctactacgccctgcgtcttgcccgactaatcggctgcctgtggcagcccgcacgtcaaagcaacagccagtatcatggacaagggatcggcctggctgtgagtggcaattttaaacagctgctcaattactcctacaatagtgcgctctggaccaccatcattgatcctaaagtcaccctcgactttttcactagtcagaaagatgtagtgctcatccactattctgaccaatacaccagttgtgcaggctacgatgccgtcaccgtcacgaagcaggttgatttgttcctgcggttgcttcagaccggaaaccagtcagggcaacctgctgttgacagtcagcatttgctggctgaatttaacgcctttaatggcgaatggttgctgaaaatgctgcgctccagtgaaagggagcggaaagagaaacacggtattataggcgcgtacaaatttgtgcaatccatgctgcaccagtccgatatttgctggataccattatcggtggccgaaatgatccgcgtttccggcaatgtcggcctgaaaatgaaagagagcgatttatcgagaaatttacagggttatcgtaaaggtgctatctctgatgatgtgctctttgttggtttcaaagaaaaccgcctctatctgttgccgctggaagttaaaaccggggcgcgtcctgattacagctatgcaggccaacaggctcgtgagctcaaacgttatttacagcaggacattctggaaccacaaacgctggcatcacaattgtaccgggcgctctttattcgtcaggtgctgatgcaggtggagaaactgcgcctgtatggcgtactggacagcgaaaaattgactcccttgctggaacgacgggaatggtggttaacgggcgactatcagttaggtgagttggccgactatgcggacggcttcgtcgtggcgcatgtagacagcgcaacctgtttcgatctctcctataaagagacagcggagaatatcttacagatcgaaatcccttattcactgctgccttcgttgattgctgcgcaaggggatgaaccaccgttggcggaacgttaccgggtgccggaaaaataccggcttaagccagcgtgtgatgccagtccgtcacaacccgaagtcgtggtagaagtcacaacgccgtctgctgcacagtccatttcggaacctgagtcggagtcgttacagcctgctgtaccggtggtgacaccagatattagcgatactccattacagatcctgtttggtcatgatgctgcgcgccagagcccattacattgggagccaaccaacaccgccaagttcatgaataccaataccggcattattggaacaatgggcaccggtaaaacccagtttactaaatcgctggtcacacagttgatgcgtaatcagtcttgtaacgttgatggtaaacctattggtttgctgatcttcgactacaaatccgattatgtggatgaggcttttcttgatgccacgggtgctaaaaagtacaagttatttaagctgccttacaaccccttatctctgtttggcgacacgccaatgctaccaatccatactgcaggtggactatcggaaacgatggctaaagcctatgggctgggccataagcagcagctcaaattagaaaatctgattttagaatgctacgaagcagcggggatttcacctgaagatccgacaacatggtcaaggactgcgccgacgattgaagatgtatggcaacgtttcctcaatcaggaaaaggttgaagaagattcactttacgcagctctttcaaaactggcgcgttacaagatattcgagactatcccggagaagatgaccagcttgtacgaattgattgacggcgtcaccgtgatcgaactggctggttacccgccagaagtgcaaaacctggtagtcgcgctcacgctggatctgttttacgcgcagatgcaaaagcgcggtaaaccagtcgtgcggggagattatcgtcagctcaccaaaatgattctggtggacgaagccgataactttatgcgtcaggatttttccagcctccggaagatccttaaagagggccgtgagtatggcgttggtgcgatcctgtcaactcaggagataacccactttaagactggtgaaaataactatgcctcatatatcttaacttgggtgatccatcgtgtttccgagattaggaatgcggatattaaggcggtatttaacgtcgatgataaaggtgagcaggagtctttaatgggaaagattcggcagcttgagaagcattttagcctgtatgtggatggggataagcgggttaagaagatgcgtgatcgggcattttgggagttagctaaatgacaattattgaagctatcgtaaatgtattaaaggagcatggaaaacctttatcacataaagatatttatgatttcatcataaataaagaatattactcatttggtgcaaaagatccagtatctgtagttcgtggtgaaattcgaaagcattgttatggagttgatttcccaagtgcatcaccacggaaaatatttattgaggttaaatctgtagggcaatcaaagccactatacaatttatggcagggacacgtatcaaatgctagccctcttaaaactgaaaaggtaacaaaagatcagctaccagaagagataattcatgggaagtatattgaacatattaaaaccataaaagagcaattgcttgatgctattaattcttcggatccagctttctttgagagccttgtagttacacttctattaaaaatgggttatgggtggcacgagtctgaggcaggtaaggtagttggtggcgctggggatgagggcatagatggcattattaatgaagataaattaggcttagaaaaaatatatatccaagctaaaaggtataataataaaaaagtaccatctagtgaaattagagagtttattggctcgatgaaccaaaaaggagcacacaaaggggtatttttttcatcttcatgctttaccgaacaggcaattaatagtgcagaaaaagcacaaggcatgaatatcactcttgttgatggtggacagttatgtgaatatttggtccaaaatggcatgggggttgcaaaggtaagtacatatgaaatttatgaaatagataaaaatttctttgatttataaagttaatataaaatggggtctcccccattttattaaatttgtttttttatctcgtccttgaaatctcgtattttattgaagaaacagttttttatcgtatctaattcgtttcttattttcccaattttatcagaaatctccttgcatttttcagtattgggattttcatcgcttgtttcaaaatctattataagcttccttagttctacggttttttccttataactatctacacattttttaggttcaaaagcgcctattgaatgtaagaggctggaagccatgttttgttctttaaaagcagggtaaaccttttcagaggactgtttttctttatcactaaagcttccatctaatggtttactactaggatcgctcaatgttttatactttctatgtttgttcgaagcatataactccacagcatcggaaaataagcaaaaacaatcgaaggctttatataatagatctacttctttttcataaactttgctacgagcagtttgattaggtgttttaaaaaaaatataacaggttaaaagtattattgccacggagctaattaaactccctatggaggtcacgtaatctacccaatctttggtggtaactatttctgttagttctttgatctgatcgaaagtaatttccattttatttccttaatagccagtgcataacgcactggcataatagttatcattacaatgaaattaacaagtctcttaaatttcgatggtttctaactgaagcgattccatcctcaacatgtgctgcccatgctttaattatcaatttttggtcgagcttaggataaagcatcttcaataccaattctgtagtctgcaatgtttcccccagccacgttattttatccagcaccagagagccatccagcttcttactatcccgctcaggcgaataacgaaactcactctccaccgagcggaaaaatgccagtcgagccgcgacattgggcgtaatcccagtgtatccctttaactttttaagctggtcttcagtttgacgactaagcaccattcgattcgggagcatcagatagcctccttagttaattcccaaaaataaccaggtttaagcgtagatgattttgaatgtgcattaaacacaatctcataagcatgcgaaatatcatcacgtaactgatcgacaaaataacgctcatccacttccgtatcggtagacagtagcactacctgatggctggcaaacgggaaatagtgattaatcaacttatctctatgttgggaatccagacgccctaatggagtatcgataatcaccggtaaatcacggcctgaggtttttgccaaagcctcaagaatcgcaattgcataaatctgcttttcaccagcagaaagtagcttacggtttatgacggaaccctgttcattaatcagctccacgtcaaacgtttccgggttaatatgcgcgctaagttgcaaatcttctttacgggctaatttgcgataggcgctttcgaaattcgctgacagtgttttcactcttgcctgtgttaatacatcactgtatcggtcgagtaaattaatcgtttcctgcgcgtttttaaaggcgctactgaagccatgctgactgcgggcaacatcatgcattttttgtacctgacgtacgcattccagttgctgttgcttaacctttttagcgtcttccaacaatgaaagatatttttgccgctgtttttcacgttgtttatccagttcgcgtagcttctcaaagagatccattaactggtcatcttctggggcgcgggcaatgttggcggcagcttgttctaattgctgttcaatctctgataactgggtacggtaaagatcgaaacgttgccatgcctttttgctgtcttgttcaatcgactgctggagcataccggcttcacgttcagagatatcaaacaacaaatcgcctttaggcttggttgccatatactctttcaaattatcggtaatcgcttccgtagcaattttactggtggtactagaacgcaatgcgatatcgtttttaagctgagctaaaaactgttccagctctttttcaaaactctgagtttgcttaatctgagtttcatcagcaattttccccagcaaacgagctaatgtcttcggggctagcgcataaggtagcgacccatcacattcctgccgcagtgctttttccagacgctccttatctttcagcaaagtatcaactttctgtttttcttgcgctttagtctgagcaaatgcgccgccctgtgcattcaataaaccttcatagcggattatatctttagacagaaactcaatccgcgatttggcaaaatcggcgctttccagtaattcttctgtctggcaggctaattctttactttgtttttcaagctctgcaatctgctgttgttgagatcctactaactgattggattgctgacgcttaacaaaaatcattaagtcattgcgtagtttagaaattagatccaggcctaataaacgacgcacggcagtgcgaagaatattgccggattcatcttccgccagctccgcaattttctcgccatcaaaaaagaacagatcggcaatgccatgcggaattaattcattaagaaacccctggcactgatcgtaatccagctcactgagtggcaccccatcctgttgcaaagaaaggcggtctttcttcccctttttccatgctcgcgtaacggtaaactccgcttcatggccgcctttattgtaggtaaaggtcaattcaacagccgcttcttcaggttgctcactatagtacgcgccgctgtgaattaacgagctaagctgttcaatatattcctgttgctgagtcgcaagtccaaatgccagccgaccatacaacgccagacggatcgccgacagaatcgacgtttttcccgcaccgtttaaaccaccaaacagcacaatagggcgatgattcacttcatgtgggcgctttcttggagccagatcaatggtgtgagtaccgttaaatacccgaaaattatgtaatactagttgtttaatgagcacgttcgttttcctcctcgactaaaacagaggattcgcttgaatcgacaattctgcgctgtagaacctgaagttcagcttccagcctggtgacttcttcctgatgaatatcccggtcgttacgtttttgtagcgctgcctgttgctgctggatcttttcgagactgccccaatcctgttttagaattgtacctagcttgtcaaaaatcccttggcgacggcttagcccttccattgatacttccagttcaattagcttcatgaccatttcgggggcaacgtcaaacccctgagctatctgcaccaataaatctgcatcgctggcgtcaaagcgtgattgatcatcaactatccagtccagatcccgctgataaacgtcatggtaaataccgggtaatgtgtcataccagtctggttcattaggatctttcagccattcctgacggatagcgtgcagctccggctgggtaattagcgtaatggtatggccctgggcattcaaatcacgctcaatctccagcagtgttttcagccactgctggcgatacttcagccagtaagggccgggaacatgcttacgttcggcactaatttcttcgccatctttggcatactgataactgaccttgccagtacgacgcttatagttacgaaacgtatctttatttactgggtcggtggtaaacgccagtagatcgcgatatttcagcagcggagacatccactcttcgccattcttaatcaggctctccatcgctttatctttggtgactacggtacaggtccagcagccaaagcgggagttaccacaggaaggggtgctttcatcgatcaccagtggacattcaccctgtgcggaagagtccatatacagcgtccacagcggacggttgtttccgccccacgggctttcccattcgtcgatatcttcaggggcataacggaacgcgccgcgcaacagcttccagacgtcttctacatcccaggtatcaataggggtatagataaacgcatttgccagcgtagtatgtcgggccaggcgtgagccatcaattttgtgctttgctatgacctgcgcacgggaggcactctcgctactacgtgagccaaggacaacaatcacttcatcaaactggctgaccttatctttaataaagtcgctcaccggattgattttcatacgctcggtacaccagcgaaaactacgggttggcgctggataacctttcccaagcagatttacccagaaggtttcattggtttttggcgtaaccgcatgctgagtgataggaaggccatttcgtttagctccagcctctatctgcaacatggttttttttatcagatcaaccaccaccggtgtttcaaccagcgtatcggatgacaccaaaaaaacatctttgctgcgcatttccggaggcaggccgagcaaggccagatacaccagcgtgatcacagcggaagaatctttcccgccgctgtagccaattacccacggacgcttatccgcacaataaattctttgaacctcagcaacatattcggccagagggcgtccagcgaactgttcctgattaataaaatcttcgtattcggccaaatcgtaggcctgaactaatttactcatgagacaaccatttgagcttcaagctcctgttcttcaggagtgagggggattgagagcgcggtttttagcgcattacaggttaactgaatcgatacgctagtcttgctcagtttaccatgctgcattgctcgcttaatcaattctgggttgctttttcgccagtcaaaagtcttgagcacagcgattctcagctgccagtgttctggttcttcagtcaggagtgagcggcccaacattcctaatgcctgaaggccaataccatgcgcgtgtacataatcttgtctcaactgtgcaggtgaaacttcttttctggcagcaagttgccagtctggcataacctgagcgatcgcctgccaatactgcgtagcaatatttgtattctcttcaagactgccatctttgggatctttacctagcagcgctcgtgtcgcctgtttgatactgcttaaggtaaacagcttgtttgagagcgtactgatgctagatttttctaactctgtaagccctataaatggttcaactgacatcgctagataacgtgcaagattagaactgatgtcgcggtgatcatacaacgttgataatgaaggacttggacggatcgcgtatttgttcaagtctgcgaacatttgctgactacgttttaatccttcgtcgacaaaaaagagcacagggatattatcctgtcctaattctggacgttcttccagcgcgttttcaatggcctttcgacgatgttgtccatcgtttatgagtatctgtgcttccatcgggacgcgtaacattccgaggttatttgagccaggaaactcatcaaattggacatcaattgctattgatgcggttaaggctgaaaaaacatagtctttcggattttcaagaagatatctcaccatctcggggattcgagacttatttaggatacgctgagcccgtagctctggtgggacttcattctcatcgaagttgaagatcttaggtatgattcgcatagggcaggtagcgatataaaatgggcgacctgcctgaatcccacgcacagcagggaatgagtaacaataatctgcgtcaaaaggctgcattgttatgtccctttaaaatataagaaaatgattacgtaatattttacgtaatcaacaggcatttttgaatttttttaacgtaaataattcttttttatagtaggtgactgactttgttactatatacatgtattaccatagacttttaccttggcatcatcctctctacttgcttggcaccgttcttaacatctttacttcccgcagagatgacccgggtcacagccacgacaactctcacccccgcccatgtcagcgccccaagccagtacgcaggcagcaccacaaacatggttcccatcacgatcaaatcatcagaagtgttctgtaagccgtacaggtagaaatgcgaagctctcgctataaatcatctccatcagccagctatccaaccaaccggccagctcccaccagaaggtaagcaagaacagggcgaattgcacgaagctcagcgtaaccacggtttttaattcccacgcagagaacagcagagtcacaggaatacaaatcacaagggccattccaaggaatgcctgcagcatcggcaacgcctggcgcacgctgtcgaaagcagggaaaaagcgaggctggaaaccgacattccggcgatactccccaaccacttaatgcttgcgatgcattcaagttatctcccgcattcccgccaaacccgttgtacactcgcccatcctgcgacacctgcatattgcgtgggctcaccattgagcgtagtaccacttcttcatattcctctttcgactgctccagttttgcagccgctgccagagcgtcgtatcgacctgcttcagtagtcgatttttcagccccgcatcatcatcggaccaccatttcttacacactggatagccaccaccacccgtatcacccaaaccgtcatcgcggctggcgtcataaggccaggcggcgagcgcggtgctgaacaggtcggcaaattggcatcccagcgccatcagtttggtccaagcctattccgccgcgctgcgtagcgccagcaggcggtcgataaccttatggataagaccactgtacagcgcgttgggaatgcagggcagcagccagtctacggtctgtagtatccggctgatttgcgacaggctgacgggatagccatcgcgggtgagttgctccgctagcgtcaattgcgtcaggcatccaatgcctgcctcgtggtaaagatcgcgcagatgcagaataccttccgcccgttcgataaacatcaatccgttatgcagatcgctttcctccagatggtcgagcaggcactggaatttgccctgctgcgttgacagcgtttcgggccgcggacgaaacggccagcagacgcggtggtaacgttcatcctgcgtctcctgccacagttcattgaggatggcgaggcgcgtattcccaccgctggcgagcatatacttttcatcaccgggacgacgggtcaataccggcgggttatccagcccacgggtgtgaaataacgctttcagtgcctcatagccggggttgcggatgacgcggggattgaggcgaaacggctggatttgctctaggctgacctggaccatttcctcttttccggtagtgctggcaccgtgaagccagcgattcagcaggtgtgaggcgcacataatcttcctcaggtattcagacatcacgggtaagccggatgcgctggtggatccaggcatccaccttgctttccagctaggcgacgtggcggctgttgagtcggatggacggcggaaactgttgcagctggatttgccgataaatccatgatttaccgaagccgattttgtcttccaccaggcgtaagcgtaaaaatttgccgctattcataatcattccttctatgtccagattcgctcacatcaacacgatgggtgtggttatcgaagaagcagcgtccctgccaagcagtaaaaatccttatctgggttagtgagagttgatagttgaaaggattagttgattgcgttacggcggtgcgccgcgctggagcgcggtattcagcgcttcggggctcagcggcaggtgcataccatcctcacgtgcccagcattcaaaaatgttcagcaatttgtaggaatgctccagcatttcatctttcagttgcgggttgtgcttgcagtccagccatagaaaacgggaaagcgtggaagtgatccgctcttttgattctggttgatagtgatccaaaaaagcctccagctgggtatggcggatgacgaacagtgcgtaaggaggtagcgtgtcctacagggagcagtcggacagactgagccgggaattaaggtcattggggccattaccatggagttggccaatcagcagacgcagctctttctgaagattgttttgcgtggcgagcagttccagtaaaagccctcacaacgatttgcggcagcagagttagtagtagctgtcattcttatcgctgaccacaatgttaatctggttgcatcggggcaaaggcgattcaacattttcttcagatgctggtggagcagtaggcgctcaaggccgattaacggcaaattccacaggtagctggtggtcagtagcagagtcgcgtcgcgtctgccggcgacatgtttaccatcgctttgcagttgccgggtttgatgcactacgaaggtggaaagagagatttattgctccggcaggcaaagcggcaaggtggattgagtgatttaagaagtacgggcgaagggaagtagactgagagtggcagatcgccgtgcagggcatggcggatctggtcgacaggcagcaaagtgatatcgtgctgtcggatgacttctgcggcctcgtccagcgtcagccactcagggtggattttgtgattaaccataaattacctcttttatttttttgtaaaaatgatgatttttgcgtgatccctcgcaatgatgtcacctataatgttgataattatatttttttgtattacatgtagtgaacattcattaattctagcttaggtctggggatggccactaacccttgggcggtagcgtgactattgcaaatttgaatcgaggtcaaaatgtctactaatgatgcattcggcatttttaatcaggaagatatatatttcttcaaaaaaacaggttcttttggacgtttttctacaataaatagttttccaattgagtattttttaacttcaatgaaggccagtgaattacatcaattgacttttgctagggaaattaagcctggggataaaatagactttgatcaactgttacagcgggatttagatttggttagagtagaaactgaaattaaaccttatcttacaaacaacgactctaagtcaaggacaatattttttccacctttacttgttgccgcaatcccagtatcaaaaaatacaatggaagaatattatagccagcagcaaattgataaaatatctataggggggcgtgaaggttatcttaggaaatgggatggcttattcaagcttactcatttagaggatcgaaattatacaatcacgccgtccttagcggataagaacaactcaattaacgtagcaagagaacctactcaaattgaaattaatctatccaatgggattgaacgagggataaaactaatagtcatagatggtcagcaccgcttaaaagctcttcaggaagtttatgctgaaaatggagactcgttgagtgaaatggctgtacctgtatgtatattattttcacctgactcgactttagaggtggctcagtctgtagaacagactaaacatgtgataccaaaagttccagagatatttagacagttatttgtcgacgtcaataaaaatgctgagcaggtcggcgggcattttaatatcttgctttcagaaggcaatatggggagcctaatctgtcgaagtttttgttcctttgtcttatctaaaagaggtattgagggacttgcacaaattgaatggaatcaaaagaagaagaaactctcaacagaaattaatcgtagttactatctgactagtattggtgtaatagaaaaagcgttggctgaaacattcggtaaaaataaatttgtaaatgagtactttataggttttgatgaaattaaatatatcgttcatccatctgaaaatgatgaccatctagaatttccaaaggtttcatgggataggttttcgttgtcacaaaagaaacatattttatctcaaattttgaaaaatgttgttccactattagaaagattatttttcgaaagtaatctctttaagcctgcaaatgattgttttattaaagagatagctcgattaagggataagtccgaaacagactctcatggtggaattgcatttaaacctgttatggaaaatttactggaatatatgccaattccagatactgaaagatatagagatgctagacataatctaagactatttgaagaagatgttaaaaactgtaagaaagaacagtgttttacctttttaaaccatgcaattttccaacgagcaatatttttggtctggagtgacatattaaaaataggaaatagagttggtttaacaaaagaattttcaaataatttcttctttcaattgattgatgaacttgataataaagttgatgagcttattgacttcaggaaaagtttttgccaaaattttatttttctttcaaatagaattaatcctactaatgaagtgcgcaacggtatatcatatttaattttatcaatgctttctaataaaaaagtacgtgaacgattatcagcttctgtaattaataccgataacgataaacttttaaattcttttaatgaagaattaaggaatttatcttattcttgtcttaacaagtatatggcttcatatcgtaaaaataagacaaaggtatttaaaactaattatccaatagataattcaatagataatgagttacgaaatctattacaagaagaagaaattaaaaagaaaagagaaatgaaagattataaggacggaattatctctaaagatcaaattactagtaaatttgattttttagtggatgattatgttaaaaaagatattataaatgtccaaaatgatcttagaagtgctttaaaccttgaattagatgtgtttggtttaaatgatatttctccagagttagttgaagaggctagtgagttcgagtctttggatgaatgaattctatggaaatgttatgtgttaacctcaatagattttataatgactctgatgtttttgagatcctcgaggaggatctcaaatcaaaagtagttgatttcatcataattaatggagataaagatgtatataataagatagctagttatttaatatcacctaaaatttatgttggtttttcaccattaaataaaaatgatttaaatgggttgtgtttgttattaagttatcttaatgggggttcagactataatttggatttttacgaggaagataatattcagacaaaggagcagaatccgttggctgcatcatttattgattatcttgaatccaaagatattgaatcagtcatatacaatacccgagagattcaaaaaaatataagtctatattattcttcaattccgaatattgaaaagaatctaaaaccatacattgattataacattgttattttttcattgtataaaacatctattggtatctgtcgttacaatgagatggaaaaagatctgtataggtcattaagaaacgcgacaatatccaatcgtttaaatgccgcattgtgtgatgcttataaaaactgccctgatttgtttgatatagtaaagtgcattgaaaattacctagtaatggttaaagccaataatattgatgcattaattttttacgtggcattattcttgaatttatctttatttaataagaataggaatgaatattgtattgcttatctttatttgcagagggctgtggaaacagcattaatttaccactatttggataataatgtaattgaagtaaatgattatggtggattgtctttcaaaggtgatgttaatgaaatacatggtgttggtgagttgattaaggaatacttttccagaaggaaagataatgaattgagcaaaaaaatatggaagctaaactctttgagaaataaaatgctattggctcatggttattacacgccttcaggtgtggactacgatgatttatattgcgcggttaaagaatttgttctgattattataagttcagatgagtctaaagctttttatgaaaaagtattgaatggattaaaacccattggtaaagaaaaaataaaaacagagttatcatttgctcttcttaataattaaatataaattggttattttttaatatctttgttgaggttctttaggtatgctatatttaatggatggtgaaatagtaatttattcttggggatttaatggataatacaggcatgtttaacaacttaaatataattttcttgaccatgaatattagttatagttccagcctgcgcagttagagtatatgcgtatggttaaaggttcggaatggagagaatgcatcggcattcatcacgagtaaacgtaattatattcattcaatcctttctacaatatggcttaagagaataaatgccaccttattatgccacttctttggattgctgctgcaatagttaacgattaaacatataggtatccctatgcttcaatctctgaaccacttaacgcttgccgccagtaatttgcagggcagcctgagcttctggcgcgatttgttagggttgcagctagatgctgagtgggataccgacgcataccttacctgtagtgacctttggatctgtctttcttatgacgtatcccgtaactacgtggccccgcaggaaagcgacgacacacattacgcactcaacgtcacgccaaaggattttgagccgttctcatataagctggaacaggcgggagtgacattctataaagacaacaaaagcgaagggaaatctttctaaattcttgacccgaatggccacaagctggagctgcatttgagaaatttagcatctcggctggcgcaatgccgggagaagccgcattctgaaatccgtttcggtcctggaaaataatcacgcaattttctgatcttccatgcagtattcaattttatgcctcgttttggggcaagctctcaaaataaaatctcataatccattaatattaaataaattaaataaaggaaaatcccgccttcgtaccactcaaagccgccaccggcggctttaatgctcttacctcagacccactatgcttcactctttcccttatcaccaactcctctcatcaacccccgcctgtccaccttcttcccatccttccccacatatctttcgggccatatcacgctcggatccacccccagcgcctccgcaatcaaatgctcccctttaggccacggacgcgtaagcgcattcgccagcgtggaggaactcaatcccgaagcgcgcgacagcgctgccagtgacgttccttttttacgtaagcctgcgatgatatctgccgaatgccaacctgttgtcataatccctcctgacgtgtcatgtaagtaaaaccgttaccgcataaatgctacgttattcgtagtatggagtctaaacctaaaactacgaatttcgtagttatgcggatcgaccgagatttttatgaaatagagtgcaaaggctgtgaggtgtatggaaggcgctacgcaatattgaatttctgaaaatcacagcctttgcgccagaccagctaactgcctgaactgaaatcaatactacgtttctcgtagtatctgccggctggtaaaactacgactatcgtagccatgaaaattaccagcaattactccgacatcttttgccagcgcctcaaggcagcgcgtctcgcgaaagggctatcacaaaaaagtcttggcatacgtgccgggatagatgagtttgtggcgagtacccgcatcaatcgttatgagaagggcgtgcatcaggccagtatcgaaacggcgcagcagcttgccgccgcgctggaggttcccctcgcatatttctacatggcagatgatgagttagcagaactcacacttcattgggctacgctctctggtgctgacaaaacgcagatccttgctctggtaaagagcaagtccggttaaacctccgtacgtctttacccccgccccacaacccccataatcacctccatcaactcctcaaccgccgcctccgcatccagttccccggtcttcgctgcatagctcagcccctcggcagcaccaaaaatcgcccataaaccggcatcaggcagcgccttatcaggagagaagggcagcagaaggtcgcggcacaggtgcacgaaatcccgcgcgtattccagcttaaacacctccatttcgggcgatgcgctcagcgcggccagcacctcagggatctcaatgccctgggtcagcacgcagttgatgtacgccagggcgatggcgctggctttgtcgtgcaacgtcgggccgctgcgggaaatcgactgggtaaagatctgcgcctggcgcgcttcaaagtcccggtacagcgcaataaacagcccggtgcgggagccgaaatggttgtacaccagtggcttggtcacgccggcaaactccgccagcctgccgggcgtcagggattcggtgccctcctgaccaataagtttccaggccgcctccagtaattgctcaaaacggtcttctttgctcatgcgcttttgcgtcatcgtcgggcctcctgttgacaacggcatcatccatcgctaagttaccattagtaagttactaaaggtaacttcagattcaagagtaaaagagttccccggcagaagcaatgaggaaaacctatgcaaactctgatcgtcacctctcacccgtctctcacctcgctcacccgcagcgtggcgaaccatattgccgacggcatcaccagcgccgacagggcgcattgcgtggagattgccgacttacatcaggagaacttcgcgccagcgtatcaggaggtggattatcaggcgttcagcggccagcgtgcggtgcctgacgacgtgcgccgggagcagcagcgcatcgacgccgccgacaatctggtgctggtgttcccgatttactggtggtcaatgcccggcatgatgaagggctggatcgatcgcgtgtttacaaatggctgggcctacgaagagtcgcccgacggcaagctgctgaaaaaactcggtcggctgaacgtctggctggtggggctgggggcggcgacggaggacgtctatcagcggcacaactactttgaggcgatgaaaacgcagctggagcacggtatttttggttactgcggcgcgcagttctgggcggcggagtggatgctgccctcgcagttgccgcgtccggaggattatctgaccgccgcccgcgaactggggcagcgtatcggtagcggcgcgcgttaaacggcaacccccgtcgcgggacgggggcgttgggttattttttgccgttcggttttaactgttcgcccggtttgagtttgaacagctcatcgtcgcgggtggagtagcgcaccgtgccgtccgccagcagatatgcgccctcggtgaagccagcgccgttaaggaaaggagccaccgcgtcgggctgattacggaaggcggcttccagcgccagtagcgcataaggcgcgatatggtcgatgctggcgaactctgcctgcgggtcgtcgacgaagaagccgttcagacgacgggtattcaggatgttggtcgccacgcggtccgccagcgtcagatagtctttattgccggtggactgccacagatcgataagcgcgaaaatggcgtacggctcgttgttatcggtgttcaggttcagattagtgtccgtgccgcctggcgcgccgatgtcccccagcccctggccctgcgcaatgccgcgcgccactatccacatcgccggatccggctccagcgtccaggccctggcataggtgagcagaaactcgttgcccgccgggtagggcttcaggatgctgccttttttgccgtagtaaccgtcacgttttaactcatagcccgacagatccgtgccattcgccagcatcggacggaaggtgttggtctgtgcgtcataggcatgagtggcgaaggctttcaggccgtcgagcgtccattttttgatgtcgtcgccatccttaccgagggattttgccagcgccagctgcatcagcgcgttctcggagtaaagcgtgctggtgcggcctttcagcatcatgttgccttccagcgcgtcggcacccagctcaggcccgaactggcgccgggcgcggtcgccgtatttcgagttagtgtccgtgtcgtcggtggtttccgcgcgtttgagcggctgcgtgaactgataaacgcccaggccggtctttttatcgcgcggtaacacatactgttccgccagacgcttcgcccagcgcagcgccccttcatcatgatcgtactgatagagcagcgaggcggagtagatcagatcgtttccggcattcaggaagctcagccctttggtggcgaaaaacggcggctgttgctcaaaatcgttctcccagagcttgcccatcgctttgccgtattccccgtggcggctggtttccagcgttttccagtcgttaacatgcgcattccagaacgctttgataaagcgcgtggtggcgggtttatccacggcaaacatcagatcgtaataggggtaagcgtttttcagctcatgaaccatctctttttcgctcgggccttccggctggagcgttttcagatccacaaaacggtggccgccccataacagcaggccgctggcatcctgataatggtcgaagtagtagcgcacattgtcttcggcacgctgtttatattttgcgtcgccggtgagattgctcaggccgaccagcacgcgcatcaggttctgctgggcagagaagttcgacagcacggcttttttgccgtccgggaagatccactccatctgtttgccggtgcgcggatcgacgccgtttgccagcagcggcacgttgtgcccgtaattatcccccgccttatcaaagacggtgtccgcgaacgttttaacgctgttcaggcgttcgctctcctgcgccatggcgtgagcagagaacagactcagacaacttatcgccagtgctaatcctgaaattttcattatttgcctctcagtcaaataagggttttatttttatgctgctgcccggatgtcatcagaaagaatatttcacgccgacgcggtaacgggtttgtctttcatcggtaaacttgctgccggaaacattaccaatcgccatataaggggaccagttcttatcccatttgtaggtcagcttaaaatcgtgcgtccagtcgtggctatcgttatctgccagcaccacgcctgcggaattcgcttttttataatccagctcataatccagctgatagtctttcaggaatttccatgacagtacgctggtcaggttgtagccgttctctgaggtgtctttctgcgagccgatattgccggagttacgcttgaagtaaggccggtagcgcaatgacgcgctgacgtcatcggtgagattggctttgccacgcagatacgggcggtaattgttggatgacgagccggtatccagtgaaaagcccggttctatctgaaaggttttattaattttatgaacgtagctcgccactacctcggtgccattactgacggtttcgtcaaaggctttgtctttatcctgggaacctttccatttcccttccagcgataagccaaaaccattggcaaaacggtgtgataccgccagacgatctttatgattattcccgccgctgtcgttcatttcgtgacgataatcaaaggtcactgcctgagccgcaatactcacgaaaggtacagttaataataacaatgagcgcaacataggatcccctatttttagtagtccacaggtataagatgttctctgccagtcagcagtttgaggttattttgattttgtggaatagacttttgcacaaaatgaaatggcgttttgagactgcgatcagagtattaaaaatgcgcctaaattaattaacatggcatttgtaaagatattcctggtgatttatattcaataatatcaatgtgataacttgctggtcgtctatttttacgagccgaatgaacgtggtttacagtagaggtcatgtttgacaataaatttattcctggataataagttatttcgcatttgaaaatagcgtgtcatggctggaggcataatattactggtatagagacagcaaaatgtcatcccacgctaacttaaacaaagcttaaacaagcaggaacatcacgccgatggcctgcacaaaattcaaaaaaagtcttccatgcagaaggccaataacaatattacctctggagcccgaatatgaccgtctacggaaaagatcgtttctacatttacggaatagagaaaatccttaatcaactgtaccaggagcggggcggggggaaccgtgccagtccgtcgtgcatctatgtcacctccggcatggatattgtggagatctacgccctgtatttttcccacccgcccgttcaccacgctattttcattactgacgagcgccatttcgacgcgataaaccgtctgtttcccggactgataaaactgagtctggcggaaaacctcggcgtggaggagctacgccaggcgctgaccatcatgctcctgctggcggagcaaaatcagcgcgcgggctaccgtgccgcgccctttaaatttactgccgccgagcagcagatcatgcgcttgttactgcgcgggcattcgctggaggagatcgcccaaatccgcggcgtcagcccgaccaccgtcagcgtgcagcgcaatggcctgatgaaacgcaccggcaccaaaagcctgcttgagctgtgttcgctgtacagcgccatgcgcatcgggcagcgccacgccaacccttgacccatgacaaggcggccaggcctgcgccctctttataatcagggccgtttatcttctcgcaggcaggatcgtatggcgtaccaactgaatcttaactggccggaatttcttgaaaaatactggcagaaacaacccgttgtactgaaaaacgcgttgccgaattttgtcgatcccatcaccccggatgaactggcgggcctggcgatggagccggaggtggacagccgcctcgtcagccacaagaatggtcagtggcaggccagcaacgggccgtttgaggatttcgacgggctgggcgaaaccggctggtcgttgctggcgcaggcggtgaatcactggcatgcgccttctgctgaactggtgcgcccgttccgcgtgctgccggactggcggctggacgatctgatgatctccttctccgtgccgggcggcggcgtggggccgcatatcgatcagtacgatgtgtttatcattcaggggatgggcagccgccgctggcgcgtgggcgacaagctgccgatgcgtcagttctgtccgcatccggcgctgctgcatgttgatccttttgaaccgatcattgatgaagatctggcgccgggggacatcctctacattccgccgggcttcccgcacgatggcttcacccatgaaacggcgctcaactattccgtgggcttccgcgggccgaacggccgcgatctgatcagcagcttcgccgattatgcgctggaaaacgatctgggcggcgagcattacagcgatccggatctgacctgccgcgagcatccgggccgggtggaagagtacgagctggcgcgtctgcgcgggatgatgatcgacatgatcaaccagccggaagatttccggaactggtttggtcgctttgccaccacgccgcgccacgagctggacatcgcgcctgccgagccgccctatgcggaagacgagatcctcgacgccttacagggcggcgaagtgctttctcgcctgagtgggctgcgggtgctgaatatcggcgggcggttcttcgtcaacagcgagccgctggacaccgtggatcccgtcgccaccgatgcgctctgccgcttcacgctggtggggcaaaacgagctgggcgatgcgctgaacaatccggcgttcgtcgccgaactgaccgcgctggttaatcagggctactggtacttcgacgaataatcccgccatgcccggcggcgcaggcttgccgggcctacagcaatgccttcccctgtaggtcgggtaagcgcagcgccacccgacaaaaggtttcacgcctcacgcctccagcgcaatctgcaccgcttcgccgagctgcttaagcgcctggcggtgacgctcgtcggtgggcagggcgcagttgatgcgcaggcagttgcggtatttgccggaggcggaaaacagcgagccgggggcgatctggatcttcagccggctcagctgttttgccacgcataccatgtcgaccgtctcggggagttcgatccacagcataaagccgcctttcgggcgcgtgacgcagatttcacagggaaaatactggcgcacccagcaggtaaaggtgtccatattatgttgataggactgccgcatacggcgaaggtgacgatgataatgcccgtcgcggataaaagccgtcatcgccatctgtgtggtgggcacattggtgccgctggcggcgtatttcatatgcaatacgcgatcgtgatagcgtcccggtgcgatccagccaatgcgcaggccgggggcgatagttttggtaaaggaactgcatagcagtacgcgcccatcaatatcaaaagacttcagcgtgcgcggacgcgggtaatcaaaagccagttcgccgtagacatcatcttcaaaaatcacaatatcgtgccgctgcgccagggtgagcatcgcccgtttgcgcgcgtcgggcatgacaaagcccagcggattattgcagttgggcaccagaatgacgcctttgatcggccactgttcaaacgccagctccagcgcttccacgctgatgccggtatcaggatcggtcgggatttcaatggctttgatacccagcccgcgcagcatctgcatggtgccgtgaaatgacggcgactccaccgccacaatgtctcccggtttacacaccgccagcagcgcaatggccatggcgctgtgacagccgctggtgatgatgatttcgtcggcgctcagcaccgcgccgttgtcgagcatcagccgggcgatctgctcgcgcagttcacgccgccccgccaggtcatcgtagctgaacgcatcgtgcttatggtgctgcaccacgcggctcatctcacgccacagcggtttcagggtggcctgggctatgtccggcgcgccgccgccaaaggaggtgatggcgggatcgcttcgcgcgtccagcagcgtcagcacttcgtcccactgggtgatctcgaccggacgctgtaccgggcgggacatcgccggtaccggcggctgtactttgcggggagccacaaaatagcccgagcgcggctgcggcacgatcaattgaagattttccagcacccgataggcttcctgtacggtgctgatgctgacgccgtgctcctggctcagagcgcgcacggaaggcagtttttcgccgctgcggtataacccctgctcaatgcgttcggccagcagattggccagatgttggtaacgcgtcatgctgtatcctttatcagacccgtacagatcgcaagaccagtacagagcagcggcaaaaatgccattcaactgctgttttagcggatctgtatggttaagaaaagcattttgtgcatctgtattgctggccggtatttccccatgataaggctctgttccggcgaggagagcaatcatggaattctttgaaaaccgacccaaacggccttttatcggctttgttctgatctggcgggcgtttaagcagtggcgtcttcgggcaaggacgcagcgcatactcagccagatgagcgaagcccagctgcgtgatgtgggacttaaacgcgacgatgtatgctgatgacatagcccggcggcgagcgctgaccgggcctttttttaacgtctttatgtgatcacgatcactttttcgcattccatgctctcttgttgccgctttcttgatccttcccctgataaccattagcttagccggctgcccgtctgcacagtaaccacgaagatataatgatgatgacgcctgaacaaaaatttgcccgctgggtaagggtgagtattgcctctttcctgctgatgtttgtctattttattgtcgcggatatctggatcccgctgacgccggatgccaccgtgatgcgggtggtgacgccagtatcttcgcgcgtggcgggctatgtcgcgcaggtgcacgtgcataacaacagcccggtaaagaagggcgatctgctgtttgagctggatcccacgccattcatcaacaaagtggaagccgcgcaaattgccctgcaacaggcgcgtctcaccaatcaacagctggacgcgaaaattgccgcagcccaggcgagcctgaaaaccgccacgctgaccgcgcaaaacgataaagttacttataaccgttatcagcgtttaagcgccatgcagaatgtgtcgcaacaggatctggataaagtgcgtaccgcctggcagagcagcgaacagtcagtgaatgcgctgcgggcgaacatcagcgagctgatgattgagcgcggcgaaaaggacgacagccgcaacgtgacgctgcaaaaataccgcaacgcgctgacccaggcagagctggatctggcgtggaccaaagtgcgcgccgaagcggacggcatggtgagtaacctgcaattaagccccggctggaacgccgctgccggatccgcagcgctggcgctggtcagcgagcagacggatatcatcgccgatttccgggaaaagagcctgcgccatacgcatcccggatctgacgcggcggtggtgtttgacgcgctgccgggccaggtgtttcatgcgcacgttaccagccgcgacgcgggggtactggcggggcaggaagcggtgaatggcgagctgtctgcgccggagtcctctaaccgctgggtgcgcgatgcccagcgtatgcgcattcacgtcgcgctggatgagccgctggatcagcggctgccgaccggcgcgcgcgccaccgtgcagctgtataacagcgaaggtccgttcgcccgcttcttctccgggctgcaaatccatttagtcagcctgttgcattatgtctattaacaacacgctgacccgcgttttcacgccgcacgacaagatcgtctttactgccaacgatctgcgtcagacgatgcgtattgcggtggcgggggtgatcgcgctcagcatctcaagcttttacaacacccagtacggcgtctttttcgtggtttatccgctgatgctgatggcgctggtgccgatgtttaaccggcacgtggccaagcagtttattttgagtgcggcgatcaactgcatcgaaatggtactgatcatcggctatctgtcgcagtggccggtgatcatgacgctggtggtgtttggcctgtacgtgatccgttttcgctttatgagccaggggccgctgttcctgttcggctccatgggcgtggtttgccagagcgtaatgctcaattttatgagctaccccaccaacgactggcatgtgctgctgttctccaacatggaggccagcgtgatggcggtatgcctgagcgcggtgctgcactacctgatcccggatgtcgaaccgcgcacgcgcccgccgctgatcgagaaaaacgccgcccgcgtgcggcacgaatcgctgttgtccggcacggtggcgacgatgatttttatcgtcttccaggtctgtaatctgagcgattcgctgtcggcgctgatggcggggattttgtcactcttcccgatgcattatcgcggcgcggtgttaagttcgctgtggcgtatcgtcggcgtggtgctgggctgtatgtatgtgatggtggtgcagctggtgctctacgatcacagcagccatatgttattgatgatgccgctgattggcctcggcatggccttcggcgcgcgcctgcacaccatggaaaaagtcggagcgggcgtgggctttgccagcgtcaccaccctcggcattatgttcggacagaacatgcatccgaatcaggatctggtgttcagcgacgtgtaccgcattgcgtcggtaaccgtctcactgctggttactctgaccatggtttttctggtgcacctgatcctcaatcgctttgaggcgacccgctacgtaattgatccgccgcaggccggagtgtgacaaggcgcgttacaggctgaaagagaagcgtgaaaacagcgccggaagctgtgacagcaggaataaaatcagcccgatagtgccgccgaccagcgtgccgttgacgcggataaactgcaagtccttgccgatgttcagttcgatctgctgcgacatatctttcgcgtcccagctttttaccgtgtcgctgatatgcccggtgaggaagcgggcgaactccggcgcaacgctgcgcgcggcctgctccaggtgctgattgagcgacgcgcgcagggcgctgtcggcgacaagggtttcgccaaaccacagcccggcttcggtgatgcgctgtttaacgcgggagtcgtcactttgcatatccgctttcagccagccgcgcagatcgccccacagttcccccagatagcggttaaaggcctcatcctctttcagataggttttggtgctttcggcttttgccgccatttccggatccgttttcagccgctcgatcagccgtaccgtggcacgatcaaaggcaaggcggatctggtgcgcctgatcggcgctgatgtctgccagcagggaattcaccgcgctggtgaccagttcggcgctgtgctcgccgagccattccgtcggtagcagccgcgctttgttcggatgttcggttttgagccagcgcacgatctgcgcggcgataaaggtacgggtgctctcgcggcctaacagcgtgaccagctgcgcaataagcgcgtccagcagcgcctgatgacgattgtttttggtcaggctttccagtaccagcgcggaggtgccgctgagatccaccttatcgatggccttatgtactgcgcgtttgagcaactgctgaatgcgcgagtcatcagtcaaatcgagaaagccgctcatcacctgcaaaaggttctgcccaatgcgcgcggcattttccggtttactgaaccagttaccgatgatcagggccggttcgtgacgccggatcagatcaataagcgactgggtatcgagaaatttttcctgcacgaaaaccccgagattttcgccgatgcggtctttattgcgcgggatgatcgccgtatggcgggaaatgaacggtagcgggacgcggcgaaacagcgccaccaccgcgaaccagtccgccagcgcgccaaccatcgccgcttcggcaaccgcctttacgccgctgacccagatcgagggcggcagaaacagggtcgtcacaaaagtcgccgctgcaatcagcagtagcgacagcgccagacgcttggcgcgtttaagttcagcgagtttatccatggtttaagaatagatctcctgaccgtatccaacagattaaattctctcacatttctgtcgaaataaaatcgtgctgaaaaaacgcggcattacaggtatcgtctttttatgaaacggagagtttaaaagatgaaaaaaagagtcctgctaatcgccagcgtcatcctgttgtgctgggtgatgatttttccgatgtcgctactgttttcacgctacagcatcggcgagccgaccatcagtttttataatatttttaatgtgctggtcagtgcgctggcttttgccgggctggtcaccacactggtattgcagattgaacaaacacgccgcagcaatatcgatagcatcgaacgaagcgtatttgaactgttcaatacctttacctcggacagttttcaggccgtcaaaaacgacgcgtttttatgcctgttaattgccgtaagacataagccttacggcatgtttttaacgagccgactattcccggtcgggcgtttgccttttcctgaaaaagcacggcagatttacacgcaattccggccagagctggctacagcgtctgataaagaactggcggatgtggatcgtgctgcccgccttcacctcgataacatacttaactttttttcaatgctggcgcagcgtcaggccgcgcactcggtgatcaaacaggttaacttcgcctatgactggtggcggcctacgttatggatcattgcccagttacagtatgaaatctggacgggatccgaaaccgtgcgtcagtcctgccggacgccgttactccgggaaaccctgaaaacacttgatgatatttacggatatgagccgctggtgccgggaccagcagtttatgcttatctgcgaagccatccgtggctgcgtgaagagaagctcgatagcgcctactgactcagggctgccagcggcgaagcgcagtgtgctgttcatagggcatcggcgaggggcgggtgatcatttcgataatgccgccccagggcgtacggccatagcaaaaggcgttgccgtcgccgcgctcggggggaaagctcagcgctttcggcccggtgaacattgcgccccccgcctgttcaaagcttttaatggccgcctcgatgtcatccacatacacggcaaaatgttgcagaccatagtcattcgccctgggcggctcccgttgatcgtcgccgtgcatttcaaacagctcaatgccgggaccgtgatgcagtttcagcatgcgcaccgctttcacctgcgtgccgggcgttaaacgcagcgttttctgctgcgcctcctgatcgacctcatcccctggcgcgacggaggtgtatatcacttctgcccccagcgcggcgcagaaaaaggctgtcgcctgttctatatccgggacggtgatcccgatgtgatccattccccgaaccgctgattgcgacatgatgcctcctctgttttctgccttttttcaaagtaataaaggtagaaggtaagccacgtaaaacgccatacagaaatgaaaaatcataggtttatacgaaactttacgcttaatcgcagtcgttacgtctaccattaataacccagatagcattttttactgcccatcaggaggtatttgatatggcgtaccagacaatgaatccttttaccaacgagcttgtaaaagagtatccgccccacagcgatgccgacgtcgaaagcgcgctgcaaaaagccgatgcgctttaccactccgactgggcgaaaggggatattgatcagcggctgccgatcctgcaccgcctggccgatctgatggaagagcagcaggaagaactggcaaaaattgccacccaggacatgggtaagctgattgaacagagccgtggcgaagtggcgctgtgcgcgaaaatcgcccgctattacgcggataacgccaaagccttccttgcgccggtgaaatatgactccgatctgggcgacgcctgggttgagcatcacccgattggcgtactgctggcggtggagccgtggaacttcccttattatcagctgatgcgtgtgctggccccaaacctagccgccggtaacccggtgctggtaaaacatgcgagcattgtgccgcactgtgccgaagcctttgcgcatctggtgcgtgaagcgggcgcgccggaaggggcgtacaccaacctgtttatttcatccgatcaggtatcaaacattatcgccgatgaccgtgtgcagggcgtggcgctgaccggttcagaaaaagccggtggcatcgtcgctgcgcaggcggcgaagaaactgaaaaaatcgacgctggagctgggcggtaacgacgtgttcgtggtgctcgacgacgccgatatggaaaaagcggtgaaagtgggtgtcatggcgcggttgcagaacgccgggcaggtctgtaccgcggcgaaacgctttatcatccatgaggcggtggcggataagttccttgaaaaatacaccgaggcgttccgtcaggtgaagatgggcgatccgctggatgaaagcactacccttggcccgctatcctcgaaagatgctgtcgaaaccctgaccaaacaggtggccgaggcggtgaaaaatggcgcgacgctgcactatggcggtaagccagtcgaccacaaaggtaacttctttgaaccgaccattctcaccaacattacccgtgataacccggcgtactttgaagagttcttcggcccggtggcgcagatctatgtggtgaaaaatgatgatgaagcggtgaagctggcgaacgattcccactacggtctgggcggcgcgatcttcagccagaacatcgagcgggccaaaggcctcgcctcgcgtatcgaaaccgggatggtttacatcaactcgctgaccgatactgcgccggagttgccgttcggcggcgtcaagcgctccggctttggccgcgagctgtcggatctggggatcaaggaatttgtgaaccagaagctggtggtggtgagtaagtaattactgattagcatcatggccctcccgcaggggagggccaacctccttccgctttaagcctcttattccccagattcaaacgtcatattagcgatgtgctaaaactgtgaaataataaccagcatcaagaatgatacgggaaagagcgatgtcgactgaactgctggggctgacctgggacgcaagcgtgatcccggaggttaaaaacgtgggtacccgcgtggcgttatttacctttaaaacccatatggcaggttttgtgtgggacgcggcacagctggaaaataacccctatacctatgttgaagttaaaaccctgctggatggcgttaccgtcggcggccataaagttagtgataccgagcaggtgttaaaccttgctgacagcagcaaaaagctgattgagctggtgcagaccgggcggtttgatctcgataaaaaaaccttcacgctgctacacagtattattgcccgtaacgaagcgctggaatggggcgttttccggggtgaaggggatgaggtgcattatcaggcccgcgttcacctgggggaactgggtacgcattttccgcccgcaacggaagccggcgctccggaacttaaccggatattttcagagggtgcccgccagatcaaaaccctgccgccttttgaaggcgcgctggccatgttcctttttggcgcttattttcaatttttctttgacggtaataaacgcaccagtcgtcatatgatgaatggctggctgatgctgcacggcttcaaccctatcagcatcccggctgcccgtgcgctggaatttaacgcccgaatggtgcgtttttatcacagtaaagatgccaccgaaatgatgaagtttctggtggagtgttatcaggattaacgttatgccggatggcggctgcgccttatccggcctggattatttcttcagccccataaacgccgctctgatctcctcttccggcaactgtaccccgataaacaccagctggctgtgcggtggctcgtcgccccacggacggtcccagtcggcgctgtacaggcgctgcacgccctggaacagcaggcgattcggttcgccgtcgatccacagcatccctttgtagcgcagcagcttttccgcgaagctcagcagcagattttccatcacccgcgacacctcgctgatatccaccgggtaatccatctccaccacaatagaggctatatcgttctgcttatcgctcataaaatggaagcgcggctttgccggtacgatggtttcttccagcataaagccatgagtgttaaacagcagcgccagatcggtttcaccgtggatcacggtgtagacaggcgcgcgggcattgatgcgcgccagccgttcgcgcagcggttcggcctcgccagcaatatcggttttggtgagcagaatgcggtcggcatagcccacctgcgactgggccagggtgaactggttcatctgctcatcggcatgcaccgcgtccaccagcgcgatcacgccgtccagcaggtagcgctggcagataatttcatgattgaagaaggtctgaataatcggaccgggatcggccatgccggtgcattcgatcaccagacggtcaaattcgatgtcgcctttgtcgaggctgtcgagcagatccagcagcgcgtcctgtaattcattagaacgactacagcagatacagccgttggtcagggttttgatctgcgtggcgcgatcgccgatcagctgagtatcgacggagacttccccgaactcattttcaatgacggcaattttataaccgtgctgttcattgaggatatggcgcagcagggtggtttttcctgcgccaagaaaaccggtgagaagggtgacggcaatcggggtcatgaggtttccttcttaacagcagctgcttccgccgctgccatagcgtgcttcctgacgttcacggaagaactcgttataggtcatacagggcttgtccgggtgattggttttcatgtgttcgacgtagttgtcgtaatcaggaataccaatcagcatacgcgcggcctggccgagatacttttttgcttcgcctaagttaccaaacattttccatcccgataagaaaaagcccggcggcgctacgcatgccggacctgaagtattttgtagggcgggtcagcgcagcgccacccgccaggctacttagtgatgcgaggaggttttcacgccgccttccggcactggcacgtacggcgtttctttatccgtgcgtaccgtgctgttacgggctttcatccaggttttgaagccgtagaaaatgatgctgtacaccaccaccaggaacagaatgctcaggcctgcgttggtgtagttgttcaccacgatgtggttcatgttcgccacttcctgcgcggtcagctcgccgccggcggcaatacgcgctttgtactggctggccatgtagaagaagccttccatctgcggattgtcgctgaacagcttcaggccgagcgcccaggtggtgcagatcagcagccacaccgccggaaccatcgtcacccagatgtatttagtgcgctgcattttcaccaataccaccgtacccagcaccagcgccacggcagccagcatctggttggagataccgaacagcggccacaggctcttcacgccgcccaatggatcgaccacgccctgatacagcaggtagccccacagtcccacgcagcccgccgtgccgataataccggccaccagtgaatcggttttcttcaggaaaggcacgaagttacccagaagatcctgcaacataaagcggccggaacgtgtacccgcatccagcgcggtcagaatgaacagcgcctcaaacagaatgccgaagtggtaccagaagcccatatcagcccacggcaggatcttgtggaacacatgcgcgatccccaccgccagcgtcggcgcgccaccggcacggttgagcacggatggctcgccgatgtctttcgcggtttgcaggatctgctcaggggaaatcacaaagccccaggagctgacggtggccgccgcatgcgcggtgacgtctttcagctgcgccatgatcagcgggccgttttcaccacccagctcatgcaggtttggcatcacgatgcccagaccggcaggcggggtgttcatggcaaagtacaggcccggctcgataatggacgccgccaccagcgccatgatggcgacgaaggattccatcagcattgcgccataaccgataaagcgcgcgtcggtttcacaggccagcagcttcggcgtggtgccggaggcgatcagtgcatggaagccggataccgcgccacaggcgatggtgataaacaggaacgggaagagcgcgcctttccacagcggaccggtaccgtcgatgtactgggtcatggcaggcattttcagttccggattaaggatcacgataccgatagccagaccgacgatgacgccgattttcaggaaggtcgccagatagtcacgcggcgcgaggatcagccataccggcagcagcgccgagataaaggcgtagccaatcagcgtaaaggtgatggtggtgtctttaaaggtcagcgccgggccccagtacggatcgtgcgcaatcacaccgccgaaataaatcgacgccaccaacagcaggataccgatcaccgacacttcacccacgcgacccggacgcaggaagcgcatgtaaatgcccataaagagcgcgataggcaccgttgagcagacggtaaagacgccccacggcgattccgccagcgctttcaccacgatcagcgccagcacggcgaggatgatgatcatgatcaggaagcagccgaacagcgcaatggtgccgggtaccgggcccatttcttctttgatcatctcgcccagagacgcgccgttacggcgggaggagatgaacagcaccataaagtcctgtaccgcaccggccagcaccacgcccgccagcagccacagggtgccgggcagatagcccatttgcgcggcgagcaccgggccgaccagcgggcctgccccggcgatggcggcaaagtggtgcccgaacagcacgttacggttggtcggcacatagttcaggccgtcgttgttaatgaccgcgggcgtggcgcgcgtcgggtcaagtttcatcaccttctgggcgatgtagaggctgtagtagcggtacgccacgaggtaaaccgaaacagaagcgacgacgatccacagggcgcttacgctttcaccccgtcgtaaggcgacgaccgccagacagaatgcaccgaggatccccagtatcgcccagggtaagtgcttaagtagctttttattatccatatcagacctggctttaagaccgaaaaggtcaatgtgtaagtagtgagttgaagagacagcttgccgggcagatcatgacaaagagtgcgcaaaaaacgggcgtaatctggctaagcggtagttaatggggggtgagtggtcggcgtgaggagtaagcggttaattgccgctgtgagcgccggaaaatgtgtgattgcgatcacgtgaaaatttacgtttcgtagaagcgtatggcagcagacgcttctacggaagcactttaaataacgataaagcagtatggcgtgttatcgataggttgcagcagtacgtgtctgtcacgtgattttgtctggtaatacttatcgttaaggtaacgatcaatgagttggtcgagccgttcgcgatcaatcaacgtagtaatgcccaatgtccagaagctgcgcagatcgatttcagaacgtttaatacgcgcgctcttttccaaatcccgaatcatatttttcacacaacttgtgggatcacggttctgttttacttccagcgcgatataagtatccagtgcccagcctttttttcgcagcagaaaatcggtgcgcagactattgcgtaccggatttttacgtaaatcacaccccaacgtctgttcacgccaccactcatgcccggtagaaaccagcaggttagcaaattcaatctgcatccagatttcccagccagagatatcatactggtcgataatgttgagcttctggcgaatatcttcccgttcaaaaaaaagatgtagcaaggtcgtcaaatggtcgtaatcgcgatcaatcatggggttctcccgaaaaaatcacattatatgcatggtttttaggatgaaaaaccataatgtgataattgttgttacatcgtaacttaatgaaaattatcgggataacgtgctgaattagacgactgcatggaagggggctacacactcatcgactaccgcttatgcgatttaccgtaaagtttttcctatccaggccgacaaagtgttattcgtccaaaggaatgaaaaacatgttaaaccgtatcaaaattgtgaccagtttactgctggtactgtgtttatttggccttttacaattaacctccggtggtctcttctttaacgccctcaagcatgacaaagaaaacttcaccgttctgcaaaccattcgcgctcagcagtccacgctgaacggtagctgggtggcgctgttgcagacccgtaacacgctcaaccgtgccgggatccgctacatgatggatcagaataacatcggcagcggcgcgaccgtggcggaactgatgcagattgcgaccgcttctctgaagcaggcggaagtgcgctggaacgagtatcaggcgctgccgcgcgatcctcgccagagcgaagccgcagccgccgaagtgaagcgtaactacgacatctatcacggtgcgctggccgagctgatccagttactgggcgcaggcaaaatcaccgagttcttcgatcagccaacccagggttatcaggatggctttgagaagcagtatgtgcagtatctggagcagaacgaccatctgtatgacgtggcggtcgccgataacgacagctcctacagcatggcggtgtggatcattatcagcgtgctgaccgtggtgctggcggtgattattgccgtgtggttcggcattaaaaacgtgctgattgctccgctgcaacgtctggtggaaagcatccgtcacattgcgggcggcgatctggaacaggatatcaacgtacacggcactaacgagatggggcagctggcagacagcctgcgccacatgcagagcgagctggtacgtaccgtgggcgacgtgcgcagcggcgcggacgcgatttacagcggcgccagcgaaatctccgccggtaataacgatctctcctcccgtactgaacagcaggccgcttccctggaagagactgccgccagcatggaagagctgaccgctaccgtgaagcagaacgccgaaaacgcccgtcaggcgagccatctggcgctcagcgcgtcagaaaccgcgcagaagggcggcaaggtggtggataacgtggtgcagaccatgcgcgacatcgccggcagttcgcagaaaattgctgacattatcagcgtgatcgacggcattgccttccagaccaacatcctggcgctgaacgccgcggtggaagcggcgcgtgccggtgaacagggccgtggttttgcggtggtggccggtgaagtgcgtaacctcgcccagcgtagtgcgcaggcggcgcgtgaaattaagagcctgatcgaagactctgtgggtcgcgttgaaatcggctccacgctggtggaaagcgccggtgaaaccatggatgagatcgtcagcgcggtaacccgtgtgaccgacattatgggcgaaatcgcctctgcctctgatgagcagagccgcggtatcgaccaggtaggtctggcggtggcggaaatggatcgtgtgacgcagcagaacgcctcgctggtggaagaatccgccgctgccgctgctgccctggaagagcaggcgagccgtctgacgcaggccgttgcggtgttccgcacccgtcgcgtcgcacgcccggcttcagcaggtatcaccccggtgcagaccatggcgccgacggtgttgacgcgtaaagtcgcaacgacagatgagaactgggaaacgttttaaactttaaatgcccggtggcgctgcgcttaccgggcctacaggattgcctctgtaggcccggcaagcctgcgccgccgggcattaacgttcaaatggtttgctgattgtaggcccggcaagcttcgcgccgccgggcattaacgttcagatggtttgctgattgtaggcccggtaagcttcgcgccgccgggcacatccaaatttacccgccgactttcaccactttaatttccaccatcccgatacccagctgacgcggtgaatgaccgagaatattgccttcgttggtcgactgcggatccggcgggacgatctccagcgtattgctgtgcgccggattactgaagcgcagcgtggtggtggaaagatcgtgaccgagggtcagcgtctgttcgctgttaccgacgcgcaccgggatagggcgatcggcgttcgggccaaaggctttggcggtgatcaccagatcaaactccgcgggcaacggcgccttgtattcgattttcaccgccttaccaagctgagcgttcgaccagcgtccccaggattccggacgcgaaataccgctgaactgcttcacttcctccggcgcgccggcgacgttaaacacaaagctgtcggctttgtagcgaatatcgttatccaccacttttaatttatcgacgttcgccttatagcgcagggtgtcgatcatggtctctttgaaggccgttttgccttgccactgtgcgcggtcaacgcgctgtacgcgctgctcgccgcccagctgtccctgggagacgcaccagtcagtggacagcgccagctgcggcgcccacagctgcgccatcttgtagcactgatcgacccacacgaaattatcccgcggcgcgaaatccgccagctggaagcgcagcggggcggagtattcgctctccggcagcggctcgacgcgctgatcggaaacacgcaacagcagcggcagacggaaatggctgccggaaaaggcgatcatctttttgtcggtatcgacggtgaaatccttcatctctttcgggaagttccacagccggatgatgtccggcttccaggacagcaccttctctttcatattcaggaaggattccgacagcgactggccggaaaggctgctgcgcccgaggccgataaagttatcgccgccgagaatatccagcacagtcgcgccgttatccatggtgttgcgcttgaggccggacacgtcctgctgcggtttatcgccacgcagcacaaagaacaggttgttgcgatcctgcttgctgaggtatttccaggcggtgttattcatcgccagatgatcggacgagaccacaatcaccgtgtccttgtaccagggcgaggcctggattttctggatcagcgccgcaatatgctgctggctacaggtgaccgcgctgaacgactggttgagtttgccgtccatctcatagcgtttacgatcgcaggtccgcgagataaaaccgtcaggatgatgggtgtccaccgtcagggtgaacagcgaaaaacgtttgccgcttttggacagttcttcgtactttttccacacctcatccagcacggtgtcgtcgtaaaaaccccagtcattacggtaagcaggatcggcaacctggcttttcaactcttccgcacccaccagatgatcgaaaccgtgggatttcaggaacacgtctttaccggcgaaacgcagattcgcgccctgcacgaaatggttttcatagccggagtttttcaggatatcccccagacacaaattctgcgggaagaagctcgacatggacgcagaggcgttgccttcaaaaggcgcgaacagcggaatgccgcactgggaggccaccataccggcaatggtgtaatcggtgccgggcagctgcgcggtatgggtaaaatcgatgctgttatttttgattgcccccagctccggcgtcagatccgggaaggcggcgttatcgaaataagtgcgctcaagactctcgccgtagatatagacgaggttgagtttgggatccggaatgcttttggcgggcactttataccaggtgtcgaagtccggcgagctttcccgcgactgggatttaaccagctcggtgatctgatgaaacgccgggctggcatccaccgagccgagcgccagcatcagcgccagcaggctgtagccaaaatgaaagggcatatggcggcgacggcgcaaaatccagccgagggcgctgaacaccgcaatcagcgcgaggatcaggcccgcgccgggcaatatgtacttactgacgcccgcgccggtcaggctgttggtcagcgtgtagagcaccgcatcgttgataccgtcaccggtaaagtaatcgctggcgtagagggtgatattaagaaccacaaaaaggccgagcacaatcagcgtggcggtaaaccaccatgtattgcggcctgctttccaggcgtaaatcaccacggaagcaagaaaaagggcaagggaaagtaattccgacacagcctgtcctcatcagtcgccagtcgcgcggctggccattgctgttatttttgagcgatacaatgtaaatgggatgtcatactgctgcaattctagtgtcattaaatcgtgcagtgattcagatttggtttagatgtgtgactatttgaagagcgtcgcatctttaaatgaggcgggaataatggcgggcaaagatggaaagcggcaggcgacgtcgcgtctgtcatgaacgcgacgtttacgcccctcaggacaggaagcctatcccctgtttcagtacgatatcgcaggctttggttttgactttctccgccagcggggagttgccgatattactcaggctgagttgttcaccctctttggtgttaagcagtccctggaggccatcaagatagttggtatcctgctgctgcgcggcgggcgtactcaggcccagtttttccatcacctgatttttcacgttttccgcattggtgaccgaggccagcttgtttttggcgcaatactgcaaaatgcctgcggcattgttcatgttgtcggcgcttaacgcctggttgccgccgttaagtaagccgcccagtgacgagagcgacaggccgccctgctgtgagtcattgttctggctgagctgcgtggcagcgctggagagggattcctgccaggaggcggcgttggcggcggtggagagaagggcgctgccgacaagggcgcagcaaagcatacgttgggctaatttcatctggcgtactcttgggtaatgccctgacgggcaggatcggcccattattacagggccgacgcgcattacgggttcagattgctctcaatactcttttccggtgacgcggctgcggtagctttcccagttgaatatcacccacaggctgttgcccagacgcatcctgtccatcacgcgctcaccgagcagtttggtcatttcgtccatattgctgttggtcagcatcccggtcgggcgtttggaggaggagcgacgatcgacgatctgattgatgatcactttttcgtagcgcgattcggactgcatgccgatctcgtcgatcaccagcagatcgacattgctcagatcgttgagcaactgctcctcgctgatctggcgattattgaaggtgtctttcatcgccgacataatatccgccacggtaataatgagcaccgatttgccgcgcagcagcagttcgttgcagatagccgccgcgaggtgatttttaccggtgccaggcttgccggaaaagataaagctggcgatgttgccgtcgaaggcttccacgtactgacgcgctttggcaagggcgttcatctggccttcgttctcgactttatagttatcgaacgagcagttctggtgtaaaggacggatgccggagcggttaaaggtgcgctgcattttcatggcgcggttttcacgcgcaagggcagcggcgcggatctcaccttgctctttttgccacgccagcagctcttcgcccgttttaaacgcgggtttaacgtgctctggcatcatcttttgcagacgtttcatcagttcgccgacgtttttcatcatcatcctctgaaaccgggtggaatttgattatcaggctcgctcaccgtgttcacatcacgcctgagcgatgcgccctggctggcgcggctcatctgaacgctgcgcgccagcttttgctgccactggatatggtggaagactttgccttccgcctgccagtaggccacgaatgacgccagttcttccggcgtaaccggctgcgtcaggccgataccccacagcgctgcctgacgctgaaaatccgcgtcgggctgccaggcgggatacatggcaaatttccctatcggcacgctcaccggcgcggccgcaggttcttcataaaactgtgcgtccagcgccacatcgctggccgggcgttccagacgggcttccagttccagcaactgcgccagccgcgcaggggtgagcgcgtaaaaagccggtgcattattggcaaacacggccaccgtgccgtgcggcgcttgcgccagaacggtggcgtgctggcgcgtaaaatcatcgatgccgatgacgttcgtggacaggattctggaggacattgtgctatctcaaactgactggtacagacattgcgaagggatccgcaactgatatgtgcacatagtagcacagagcgctgcccggaaagcagtgcagaaaagaaagccgggtttccccggccttaagtgttgactaatcaacaggataaaggaggcggctgcgcaagcgggcagccgtcttgtcctcccgaaaagccccctggtgagggtaataaatcaggaaataatgttcagcgtaacgtcgatgttgccgcgcgttgcgttggagtaagggcaaacgatgtgtgctgcatctaccagttttttcgcttcgctggcatccatacccggcaggtggatgttcagtttggcttcgataccaaaaccggtcggcagcggcccgatacccacttcgccttcaatgaacgcgtctttaggcatggtgattttgtcgcgtgcgctgacaaatttcatcgcgccgaggaaacaggcagagtagcccgctgcaaacagctgttccgggttagtggcatcaccgcctgcgccgcccatctctttcggcacgcccagtttcacatcaagtacgccgtcagaagaggttgcgcggccgtcacggccaccggtagctttggcaacagcggtatagatcactttttcgagagacataatgtgttccttttgtatgctataaaatagcgtgctatttatctgcgagcataatcactctgaatgagtcattatgcgcggtgtaagttttcgcgtaacttttccagctccagcttgagcgacgtcagcgtggcggtatcgcaggcggcggcgcagcctacctgttcaggaatatcccgcgcctgttcctgcaacgcccggccgctgtcgctcagcgtgaccaccacctgccgctcatcctggcgggagcgctgacggctaatcagcccggcgctctccagacgcttaagcagcggcgtcagcgtggcggaatccagaaacaggcgctcgcctatctccgataccgtaacatcatcccgttcccataacaccagcatcaccagatactgcgggtaggtcagctgcaagggcgccagcagttgccggtacactttgttgagcgccagattcgcagaatagagcgcaaaacagagctggttatcaagttccagtacgcggctggatggagcggtcttcgtcttcatgagatgaatatagatagtgcacgatttaattgcaagttatttgtttgcgacatgtcaggggcacagataacgcagcaccacctgcaccgccatcgcgcgataatgcgcttcctgggcggcgctgtcggccccgtcttcaaacagcagggtgaaggtataactgttggccacgaagtgaaaactgaagctgctcatcaggcggtggacgtcgcgtgcagtgaccgttttattaaagagctgtttgcgctgcccgcgctgcaaaatatcttccagcagatccagcgcgctgcggtttaccgtgcgcagcaccgcagactcttgcatgaagcgcccccgctgcatgttttccatgcagatgatgcgaataaaatccggatgggcggcatgataatcaaaggtgctttcaacaagctgtaccatcgcttccaccggcggcataccggcaaggttcagccgtttttcactggcgcgaatttccgtatagacgtgttcaagcacgcgtaagtacaggttttctttggttttgaagtgatagaccaccatgcgtttggtggtgcccgctttttccgcgatctgctccatgcgcgcgccgtttagcccgtattccgcaaacagcgtaatggcgctgtgaaagattttatctttcagactggcttcgtcacttttctctgagggattactgccatggtgctccacgctcactccttataggccaaaacgcaaagggggattatcaccacggcagcggcagaaaacaaatttcaaacgcgcgggcgcttgcggtagatccacagcccgggcaccgacaggccaatcgacagggcggctacgatggaagtggccttgaggaaattggtcagcagcaggatcatcagatcctcgctgtagcccagatggccaatttttaccgctgagatcatcgcggtataggccgaaatgcccggaaacatcgggatcaccgccgccacggtaaagactttcgggtgcgccagataccagcgcgaccagcggatgccaatggccccaaccaacatcgacgccataaaggtggaccattcgatattgaagcccgcggtgaccatggtcatgcgcgacccgtgaccaatcgcccccagtagcgcgcaccagggcagggcgcggtgcggaacgttgaacaccatggcaaaaccgacggcgggaatggccgacagcgccatgtcctgcatcagcgccagcagaaaatcgattatgcccatccgcgcagcccccaaactgtcattgccatcaccacgcccacgcaggtggcgagggtcagcaggctggcgatcgcccagcgcgccagtccggtattaatatgccctttgaacatatccgccacggcgttgatcagcggaaagcccggcaccagcaacaacacgctggcggccattgataccgttgaggtaagcgcgaaagtgggcagcatcagcaataaacctgcgaccgtggtcgccacaaaagcggtaatgcagaaattgatctgcggatgcatatgccgctgcgccagcgtcaggcggacgtacatggcgatgctgctggcgaagaacgtcaccaccgcgccgtcccatccgcctttattaagtctgcaaaagcaggcgcaggagaggccgaccatcagcaccatcagccagcgcggataacgcagcggcttgacgtgattgaagcgcttttcaacgtcccgataatcgagcagtttatgctcggccatgatgacaatatgctgtacctcggtcaccacatgcatgttgatcccgcgatcgctgttcttgcgcgtcgaggtgagacattcaccgtctttaattgtcgtcagcacgatagcattggctgaaatcgaactttctacgctgtccatccccagcgccagcccaagccgcgtggataattcttctaccagcgcgctttcggcaccgtgctgtaatagaaaaagaccgcactgaatacataatcgcgtgatggtccgctgtgacgcctgctctgcttgcatgtcgtgccctggtagtcaacgccaaaacgcctgaaggccaggcggaaaatctatttttagcacgaagcgtccatggcccggtcagggggcagatcaatatttattcattatctttgagaattcttatcttttaccggatgcagtgcggacggggcctgacggctactcctgaccgtttttatattcactaaatgaataatttaatttttacttaattttttttgtattttttaaccatcaccctggttatttatttttcacaatttatgcgatattagcgcggtgagagcaggatgtaataatctcatggttaatctctccagaaggaacagacgtgccaggtggcacgctacggttagtatccagggaaaagtgtcagaaaagttaaggatgaaatcagcgcttattaaaagcgtatgttttctcctgagtttctgtacttaaaaaaggagacggataaattatggttacaggaagttgtaagttcggaatcgttattagtaaagcacctatcatacaaaatggccttggcaatattattgcccaccattttcccgaatatgaactctcgtattgccgcgcattagaagagcttacgttactgcaattgcggcgcgcagatttagtggttgccgatttgtcaggggacattcgtcatccaaaaaatctctgcgaacagtactacaagttattgactcagtatcttgatattcactggatttttattgtcccgcgtccgttatacccgctggcggtagaaatgctgctgcgcccggaaagtaccttactgtctcaggttgatcccattgaggtcgtggtgaacgccattcgcgcaggcagcatcagcgccgaacggatcagccaaagcctgctgtccccggagccaggtgaatttgacgaagaagaggaaaaatcagcactgctgacgctgtctgaacgccgggtattacggcttatcggaaaaggttggggcattaatcaggtcgccatgttgctcaagaagagtaataagaccgtgagtgcgcaaaagaatagcgccatgcgccgcctttcactgcgcagcaatgctgaaatgtacgcatggattaacagtgcacagggaatgagagagctgaatctggcttcagcctacggagagcaaacggaatggaaaagaaatgtgcaaagcggcatgttgctgtcatcgaaagttgtgtaatgagtgagatcgggctgtcacatcttttcagcacctcagccttgagtatgtataagctccatttttttaaagattacccatcgtttgaagcggccgcgctgaagatgccttttttttctgtcatattttcactttccggactgcgggcagagcgtattgactgcctgaagagtctgctaaaacttgcaaaggggtatccgtccgctcagcgaattgtgctggcgcaggacgataccgaagtgcgtctgatgagtttgctttccccttccagtctgcatggcatcatcagcaaaacgctggcgattgggctgttacaggagcagctttcgatactgctcaacaatacgcatcggcttaatcaaaacgtgataaacgactggtacgtcagcaaaaataatgggctgagtccgacggagcgcgcgatcctgcactacatgacctatgggtattcgatgccggagatcgcgcactatttgtcgcgtaatattaaaaccgtgcgcgcgcacaagtttaacgccatgaccaagctgggcgtgcattcggatgcgggactgctggacgcggcggatattctgatgcacatctcgattgaccgaaaaccgcctgcggtccatatggttgcgtgaattttgctatcaatctgcacagctgcgccagacgagactctggcgcagtcttttattcacagacatccacccaggtggcagacgtaagttgcgccatgcgcgacggtgaaatacgcacggcgctgtgggtagcgcctgcggcaggcagcacttcctgatactgcttaagggatacatcgcagtagacagccagcgggttctccagcccgaaagggcagacgccgccaaccggatgcccggtggtgagcaccacttcatcgctgctcagcatgcgcgctttcgcgccaaaggtggatttcagctttttgttatccagcctggcgtcgcctttcgccacgatcaggatcacttcatcttttactttcaacgacagcgttttggcaatttgtccgggttcaacattgtgcgccgctgcggccagtgccactgttgcagtactctgacttagttcaataatttcaatatcgggggcctggcttgcaaaaaactcccgcacagaatgcagactcattgttatctcctgggaacgactggcagtaatctggcataagccttcgtgtgctgtaaatattaattaatcacaaacggatctgccggatttctcgatcctcttcacaatcacggaaaccggttacagtaaccggttgcagtgtccgtggcggagattaatactcgttttacccttcctctgtctcagataaaaagagccgtctatgaaacgtatcctactgagctttaatgctggtcctgagcccggcatggttgtaaacccgcataatggattgccgcacagctcgctgtttaccgctgctgcgtttaacttgttcgcctgacaggagagctgctatgtctgataaccatgctgcgtttaatctgattttccgcttcgttgaaaattacgtcagcccgattgccgggcgaatttcttcccagcgtcatgtgatggcgatccgtgatggctttatttccgccatgccctttatgatcgtcggctcgtttttactggtctttgcctatccgccgttttcaccggataccacattaggctttgcccgcgcctggctggatatggccaaacagttcgaagggcagatcctgacgccctttgatatgaccatgggcatcatgtcgatctacatctgtgcggcaatcgcctataacctcggcaagcactacgtgaaatcgcatcagcttgatcccttcatgtgcgccatgctgtcgctgatggcattcctgctggtagccgccccgaaaaccaaaggcgcgatgccggtagacagtctgggaggcaccggcatctttacggcgatcctcgtcgccatctattgcgtggagatgatgcgttttctgaaggcgcataacattggtatccgcctgccggatcaggtgccgccgatgatcaaaaactcattcgacctgctgatcccggtgctggtggtggtggtaacgctgtacccgctgagcctgtttatccagtcgcaattcgatatgttgatcccgcaggccatcatgtcgctgtttaaacccctggtctcggcggcggattcactgccggctattctgctggcggtgctgattgggcatctgctgtggtttgccgggatccatggcgcggctatcgtctccggaatgctgcaaatgttctggctgactaaccttggcatgaaccagagcgcgctggcgcagggcgcgcccttgccgcatatctttatggaagctttctggaccttctttattgtgatcggcggctccggggccaccatggggctggtgctgtgctatttgcgcagccgttcagtgcacctgcgttcgataggtaaactgagcgtggtgccgagcttctttaacattaacgagccggtgatcttcggcacgcctatcgtcatgaacccggtattcttcattccgttcctgcttgcgcctatggtgaatgcggtgatcgcctgggccgccatgaaaatggatctgattggccgggtgatttccgtggtgccctggactgcgcctgcgccaatcggtgcggcatgggggctgggctgggatttccgtgcggcgatcctcgtggtagtgctggccgtggtgtccgccatcatctattacccgttctttaaagtgtatgagaagcagttgctggcgcaggaagccgaagaggcattgcgtgcagaggaagagcgtcaacaggtggcgtaaaagaggatggtttttgcaggccgggtaagcgaagcgccacccggcaaggaaatctgaaggggcgaaagccccttttttatttcagcgtgcaatcaccgcactgctgcacgtccggcagacggtagcgctggcagcaggtgcggcgcaccagtaacccatcacgcagcaccacggtgcgccataacggattatcctgaccatcagaaagctgtttctcaaagaagcagaactgacgcagcgccgcgacgcgctcctcgccgagcaggggtttcatctcgttgagataccagttgatcagataaccggtgttgctccagataagcttgccgttgatgtcgccggtcgactccagcgcctgcaccaccggcatcatcgcccggacaatcagccgctcaatacgttgctggtcggaaagacgggtggtgacgtgatccgcatgcacatccatccagaagcaggcggcacgtccggtttcatggaactcaacgtgaaaatgttccggagaaacatccggcgcggttttctgggttaacagcgccagcagcagcggcggcaccatcaggcccagataccactgcgcccataacgacagcagcggcttattttcccgcagttgcgttggctgattacggtagatgtgatcggcatagatagcctgcaacgactgaagcgttgacgactgtgaccattcggccagcgtcatggcctggtgaggataagcctcatcaagttttatcacatccaggaagtgcgcacggtgcgtggcaaacgcatcacgcagggcatcggccagcgataccgtttcaggacgaagcgggatacgccagacagcatcttcagtgatcggagcgaagcgataggccatagtgcgcaactgaaatggaatctaaatgataatgattgccaatcctaactatagataaaaccgatcgcaagatctttgtccggaaagtggagggcgatcgcgcttcaggcgacttttagctcaccgctgaacaggatattgttgcggcccaggtgcttggcttcataaagcgccttatccgcctgatccagcgccgcttcaatattggtgtccgttaacggcgcgatgccgatgctgaccgtcacgttggtcgccacgctttcattaaacatgtgcggaattttcagatcgtaaacctgctggcgaatgcgctcggcggccatgcgcgcccgctccagatcaacattacttaacaggatcataaattcttcgccgccgaaacgggcgacaatatcccgcgagcgcacggcatcgcggatagccgccgacacacggatcagcgcctggtcacccatcatatgaccatagtgatcgttgtaggctttgaaatggtcgatatcaagcagcagtacatagcgaacgccgctatccagcgccagcaggttatctattttgttttgcagaccgcgacggttgtacaggccggtaagcggatcgagcatgcttaaatcattcagcgtctctctttcttccagcaaccgacacatcaaatcaagggcaaacttatcattgcgcgactggatcacgttctgaatagcaatacctgccatcggcagggcgaaggaaaatatcatccgcaccatgttctcaccctcgctaaaccacaggcagcataaaaataccggcaacgagtgcaacgtgaatgcgatgatattattggaaaaagctatggagccgataaataacacgctaattaacgcaatcagcagataaggcgagccgggatcggcaagcagcgaaaatttaatggcgacatgccacgcccataatgcgccaaataaaactgagatcggcgacacatttaatttctttgccggaaagcgccagtgccacgccagcagcgtcacgctgatagtaaacagcagacacagcgggaccgtcagcgaccgcgcgttatagagcggaagcagaaaggaaaaaagcgccgaagctgcattgagaaacaagaacaaacgcagggataaacggtatttcttgttacaaagggaatgccatgagtgtgctgtcatctttaaacttaaagtcgttattaatctgcaatttaaaatgtaatggttgccaaaacgaaaaataacgcggggaatagttaatcgcgaaaatattataaaattgttatctgctttttctgggtgagcaatttatcaccttagtgaatgtatgtcatcaggcgatgcgtaaagttcatgcaatcctcattatacccgctgacaaatgagaaaacttatcatatgatattggttatcattatcagtgtgagaggcgaaagcatgttgcagcgggcgctgggaagtggatggggtcttttattgccgggtattattgtgtccggactggcgtatgccgatctttctcttaatgcatggcgggtattgatcgtgctggggctggtactgacgccagtgatgctttatcacaagcagttacggcacttcgtgctgttgccgtcaggcatagcgctggtcagcgggatgatgatgctgctgatgaatctcaagcggatgatgtaagcaggaaggacagcgggaagaaacagaagaaaaaaagataattggtgcgaggggggggactcgaacccccacatcctgaggacactaacacctgaagctagcgcgtctaccaattccgccaccttcgcactgttatcttattttttgatattgcctcgttggtgcgaggggggggactcgaacccccacatcctgaggacactaacacctgaagctagcgcgtctaccaattccgccaccttcgcccagtgcgagcaatatcatgtgatttatggtgcgaggggggggactcgaacccccacatcctaaggacactaacacctgaagctagcgcgtctaccaattccgccaccttcgcataccatcgatactcttgaagtatcgtaaccacggaggcgcattctagatgttttaggattttcgtcaacagttaattgcgtgccgtttcttcatttgctgcaaaaaacggcactttggcaattagcgttttgcctggcgggtcatcaccgtgcggtaaactttaaaacgaccggtttgcgcgatcacttcgtggaagccaaaggtttcgtccagcgcctgcggataaggcaggaaggcgttggcgacaatacgcagctcgccgccgctgttcagatgacgcaccgcgccgcggatcagggtctgcgcggcttcaaggctggtctgcaaaccatcatggaacggcgggttagagatgatcatgtcataacgcccggtcacttccgagaagacgttactggcgaacacctcgccttcaatagcgtttgccgccagtgtcgcgcggctggcttccaccgcagcagcgcttacatcacacagactcagacgcacttttggcgaatggctggccagcgccacggataacacgcctgcgccacagcccacgtccagcactttacctttggtgtgcggcgtcagggtggagagcaacagtttactgccgacatccagaccgtcgcggctgaacacgcccggtaaggtcttgatggtcaacgcgtccagcgggtattcatcccagaagctttcggcatcgaaagcgggctgtttttccaggcgaccatgatacaggccacagcgacgggcgctgtcgactttggtcagcgggcagtatgcttccagcatttgctcggcgctacgcacgccgctgcggttttcgccaatcacgaaaatatcggtgcccaccggcagcagcgacaaaatgttcatcagctggaactgggcttccggcttgtttttcggccagtagtagatcagggtatcgctgtccgccacgtcagaggcgtcggcgacgaggctgaaacgcacgcgatcttccatctgacggctcagcacctgccagtgatggaactgctgggtgtgcgcacggcttgccgccgtctccaggcgagcaggcaggtcatcctgcatatctccggcaaacagaatacggctctcttcgaaatcatcactgtggcgcagcaagacttcacttgccggggtaaacgcagacattaaacactcctcattaaactcaggcggcgattatagtagtttgttggcgcagatacgacgaatttgctatatttgcgcgcctgacagacaggagtgatccgctatgacatcccgacgcgactggcaactacagcagctgggcattacccagtgggctttgcgcaggcccgcggcgttgcagggcgaaattgcgatttcgctgccggcgcacattcgtctggtgatggtgtcctctgcgctgccggcgttaaccgaaccgcttatcagcgacgtgctgcgggcgcttaccctctcgcccgaccaggttttacaaattacgccggaacggatcgcgatgttgccaccgggcagccgctgtaactgctggctgctgggcgctgacgaaaccgtggcgcttgaaggcgtgaaggtaacgtccccgctcttcgatgaattacgggttaaccctgcggctcgcgccgccctatggcaacaaatctgcgaacatgaacacgatttcttccctcaccacgactgatttggcagcggcttttcagatcgaaacccgcgcgcacgcctttccgtggagtgaaaaaaccttcgccagcaatcagggcgatcgctatctcaatttccggctgatggcgggcgacactatggtcgcatttgccattacgcaggtggtgctcgacgaagccacgctgtttaacattgcggtcgatcccgcttttcagcgccaggggctgggcaaaatgctgcttcagcatctgattgccgagctggaaaaacgcgatgtgctgacgctgtggctggaagtgcgcgcttcaaacgccgccgccatcgcgctgtatgaaagcctgggcttcaacgaagccaccgtccggcgtaactactacccgacggcaacaggccgcgaagacgcaatcattatggcgttgccgatttaacaagacgtaaggtgatgtaatgaactgggactggattttctttgacgccgacgaaacgctgtttacctttgattcgttcggcggcttacagcggatgtttcttgactatagcgtgacctttaccgctgacgatttccaggactatcaggccgttaataaaccgctatgggtggaataccagaacggcgcgatttctgccttacagcttcagcaccagcgttttgaaggatgggcggcgaagcttaatgttccggcgggggatctgaatgacgcctttcttaacgcgatggcggagatctgcaccccgctgccgggtgcgctatccctgctgaaatcgctgaaaggtaaagcgaagctgggcattatcaccaatggctttaccgctttgcaggaaatccgccttgagcgtaccggactgcgggactatttcgatctgctggtgatttctgagcagatcggcgtggcgaagccgcatccgaagatttttgattatgcgctggcgcaggcgggtaacccggcgtgtgagcgggtattaatggtgggggataccgccgagtcggacattctgggcggcatgaacgccggattgtccacctgctggcttaacgcccatcagcgcgcattaccggacggtgtgactcccacctggaccgtgacctcccttggcgaactggagcagctgctgtgtaaacattgattgtctgtcctctattgatgggtaaaatagccgcaatttgaatttcatgctgcgtggctttgcgccgcgcattgactaagaagaatatcattatgacgttgtctccttatttacaagaggtggcgaagcgccgcacgtttgccattatttctcacccggacgccggtaaaaccaccatcaccgaaaaggtgctgctgttcggacaggcgatccagaccgccggtacggtaaaaggccgtggctcgaatcagcacgcgaaatctgactggatggaaatggaaaagcagcgtgggatctcgatcaccacctccgtgatgcagttcccgtatcacgactgcctggtgaacctgctggatacccccggccacgaagacttctccgaagatacctaccgcacgctgacggcggtggactgctgcctgatggtaatcgatgcggcaaaaggcgttgaagatcgtacccgtaagctgatggaagtgacccgtctgcgcgatacgccgatcctcacctttatgaacaaacttgaccgtgacatccgcgatccgatggagctgctggatgaagtggaaaacgagctgaagattggctgcgcgcccatcacctggccgattggctgcggcaagctgtttaaaggcgtctaccacctttataaagatgaaacctatctgtatcagaccggtaaaggccacaccattcaggacgtgcgcattgttaaagggctgaacaacccggagctggacagcgccgtgggcgaagacctggcgcaacagctgcgtgacgagctggagctggtgcagggcgcatccaacgaattcgatcaggatctgttcctcgccggtgaaatcaccccggtgttcttcggtaccgcgctgggtaacttcggcgtagaccatatgctcgacggtctggtggactgggcgcctgcgccgatgtggcgtaaaaccgatacccgcaccgtggaagcgaaggaagagaagttctccggcttcgtgtttaaaattcaggccaacatggatccgaagcaccgcgaccgcgtcgcctttatgcgcgtggtgtccggtaaatatgaaaaaggcatgaagctgcgccaggtgcgtaccggtaaagatgtggtgatctccgatgcgctgacctttatggcgggcgaccgttcgcacgttgaagaagccttccccggcgacatcatcggtctgcataaccatggcaccatccagattggcgataccttcacccagggcgaaatgatgaagttcaccggtatcccgaactttgcccctgaactgttccgccgtattcgcctgcgcgatccgctgaagcagaaacagctgctgaaagggctggtgcagctctctgaagaaggggcggtgcaggtgttccgtccgatctccaacaacgatctgatcgtgggcgcggtgggtgtgctgcagtttgacgtggtggttgcccgtctgaagagtgagtacaacgtggaggcgatctacgaatccgtaaacgtcgccacggcgcgctgggttgaaagcactgacgttaagaagtttgaagaattcaaacggaagaacgaaatccagctggcgctggacggcggcgacaacctgacgtatatcgccccgaccatggttaacctcaacctgacgcaggaacgttatcctgacgttcagttccgtaaaacacgcgaacactaatcccggcccctcagagcgcggcagccgccgcgctcaatgactttccctgtcttattagcctcttgcggaatgttcttaattaccccgctttttcagtttgttgcttattttttagtctttcgcgcaagcgcttttaattttgttagctatatttaacaaagtggttaccgaaggggtggctgaaagcactgttcaatgcgtgaatactgacctttcatcctggcttaacggataaccataatattaataactggagcaggccagtgcgccacgggacatcatgattatgtgaccgatgccattgaaatctgcatttggtgagcttcaccacagcaacgaagcagccagtagggccgcttgacgccccggtgcgggcaaactgaaaggaataaatcgatgactatgacaagactgaagatttctaaaactctgctggcagtgatgctgggttccgtgctggcaagcggttctgcactggcagaaaccagcgccaccgataaagcgcaatccaccgcaagcgacgcagggcaaaaaatcgatagctctatgaataaagtcggtaacttcatggatgacagcgccattaccgccaaggtaaaagcggcactggtggatcatgagagcatcaagagtacagatatttcggtggaaacggataaagcggtcgtaacgctgagcggtttcgtcgaaagtcaggcccaggctgaagaagcggttaaggttgccaaacaggttgagggcgtagcttctgtaagcgacaaactccacgttcgtgatggcaaatccgaatccgttaaagggtacgcaggcgatactgcgaccaccagcgaagtgaaagccaaactgttggctgatgacatcgtcccatcacgtaaagtgaaagttgaaaccacggatggcgtggtacagctgagcggtacggtggattcccaggcacaaattgatcgtgcggaaagtatcgccaaagcggtcgatggtgtgaaaagtgtgaagaacgaccttaaagcgaagtaatgcattgcccggttaatgccgggtcttgcaggcaggataccgaaaaaaatcgcagtgagtagcctgagcgctcacgagcagcggtcgacattaattatggtaaaggagagtcatatgtttcgttggggcattatatttctggttatcgcgttaatcgccgccgccctgggcttcggtggtttagcaggtaccgcagcgggtgcagcaaaaatcgtatttgttgttggtatcattctgttcctggtcagcctgttcatgggccgcagacgtccatagcagtttgacataccccgatacatcgcaaagccagtcctcgtgactggctttcgttgtttcagaggcgttaaaattgcgctactttgtaagacacaataatttaacagggtgacagggtgggacagcgaattccggtaacgctcggcaatattgcaccgttagcgttacgtccatttcgcccgggtcgactcgcgctggtgtgtgaaggcggcggtcaacggggcattttcacagcaggcgtgctggacgaattcatgcgcgcaaatttcaacccctttgacctgtacttcggcacctccgccggggcgcaaaacctctcggcgtatctgtgtaaccagcctggctatgcgcgaaaagtcattatgcgctacaccacctcgcgggaattttttaacccggtgcgcttcgtgcgcggcgggaatcttatcgatctcgactggctgattgaatccaccgccagccagatgccgctcgccatggacaccgccgcccggctgttcgacagcggaaaatccttttacatgtgcgcctgtcgcggcgatgacttcacgcccggctacttttcgcccaccagccagacctggctggatctgatccgcgcgtcgagcgccattcccggcttttaccgtcccggcgtgatgctggaaggcattaactatctggatggcggcatcagcgatgcgatcccggtgcaggaagcggcgaatcggggggcgcagacgattgtggtgatccgcaccgtgccatcgcagatgtattacaccccgcaatggtttaagcgtatggagcgctggctgggcgacagcagcctgcaaccgctgatggcgctggtgcagcatcatgaaaccagctatcgcgccattcagcagttcatcgaaaagccgccgggaaaactgcgcatctttgagatctacccgccacgactgctgaaaagcatggcgctgggcagccgtctgcctgcgctgcgggacgactacaaactgggtcgtctttgtggacgctacttcctggcaacggtcggcaaactgctggcggaaacgccgccgctgttgcgccatgccccgcgcattgtgacgccgccagccgtcaccgtaccgcctaccgtcgtggtgccgcccgccgcggtcgccaacgatgccattaccacaccgctggtggatgcgcctcaggctaacgatgacaccagctttaacagtgaggggacggcgtgacattgcgttttatcgacacccactgccactttgattttccgcccttcaccggcgatgaaagcgccagcattgcccgtgccgccggagcaggcgtggaggccattatcgtgccctcaacggaagcggcgaattttgaccgcgtgctgaggctggcccgcgagcacgaggcgctttatgccgcgctcggcctgcatcccattgttattgagcagcataccgatcgctgcctgcaacagctggaggcgcaccttgccgcccctgatccacggctgatcgccatcggcgaaatcggccttgatttgtatcgtgacaacccgcagtttgatcgtcaggaacagatcctggacgcccagctggcgctggcgaaacgctatgcttttccggtgatcctgcactccaggcgcacccacgataagctggcgatgcacctgaagcgccacgcgctgccgcgtaccggcgtggtacacggttttgccggtagcctgcaacaggcgcaacggtttattgagctgggctattacatcggcgtcggcggcaccatcacttatccacgcgccagtaaaacccgcgacgtgatggcgcgtctgccgttatcggcgctgctgctggaaaccgacgcgccggatatgccgctgaacggttttcagggccagcccaaccgcccggagcgggtggcgcaggtgtttgagtctttgtgcgaactgcgcccggaagcaccggaagcgatcgccgaaacgatatttgccaacacccgccgtctgttttttacagataaagcgcaggcagaataatcttctccacgcccctttcccgcagcgccgccgccagcggttccacatccaccggggtggcgctgtgccattgtgccgcctcgccataaacgccgtgggcatgaaaggcgttcaggcgcacgctgacgtcgccgaggctgacaataaaattgctcagttctgtaatgtgttgcaggtaatcgctgtggcccgggatcgccagcagccgtagctcggccagtttgccgcgcgccgccagccagcggatgctctctttcacccgcgcgttgtcccgcccggtcaactggcggtgaatgtcgttgtcccaggctttcagatcgatcatcgccccgtcaaataacggcagcagtttttgccagccggtttcactcagcagaccgttgctgtccaccagacagctcagcgttgacagcgcgggatcggcttttatggccgcaaagagttgcagtaaaaagggcagttgcgtggtggcctcgccgccgctgacggtaataccgccgataaatgcgcgcacttttttgatctgcgcgataacctccgccacgctcatgcgctgcgccatcggcgtcgcccgttgcgggcagcgccgtaagcaggtgtcgcactgctgacagacggcttcataccatgtcacctgcccgttaattatcgacagcgcctgatgtgggcagtgcggcacgcagtcgccgcagtggttgcagcgccccatggtccaggggttatggcagtttttacagcgcatggagcagccctgtaaaaacagcgccagccggctgcccggcccgtcgacgcaggagaaagggatcagcttactgactaaagcgcatctgctgttcatggctgaccacgcggggttgacgttccagcatgcgcgtattgcgcgcggcttcttcacccagccaggtggtattggtgcgcgatccttccgcgcggaatttttccagatccgacagtcgcaccatatagccggtaacgcgcaccaggtcgttgccgctgacgttggcagtgaactcccgcatcccgaggctgaaagccccgagacagagttgcatcaccgcctgcgggttgcgtttgatggtttcgtcgagggttaaaatgtcgctgatgcccgccgcgtaccaggcatgatgcggcgcgacggtctgcaaatgggtgatgggatccggctcttcgccgtacggcaggcgcgcccccggcgtggtgagggtatcgctgctgatgccggactgcgcatgcagcatggcgcgctgctgccagccgtgcttcaccggcgtgcgggcgacaaaatccgccagatgttcgctgatgcggtaagccagttgattcgccgcctcgtcctgcccgtagcggcccgcgctaccgcttttctcactcagggtgttcaccgcttccgcaaggccgtagatgccgaacatcggcacaaaacgttgtggatcgatcagcccctcttttaccaggaagctatgctcaaagaaacgggactgctgataaaggaagtcgcagcgcgcatcaataatggcgatctgctgtgcgcagtagtgcgccagcgtgcgattaaaaaagtcgtccactgacgcgctgcgttcggcaacggccttcaggtttagcctgaccagcgtgctgccgccccccgccagcggcagcgagttgtaacagctgacaacgccgtagccgccttttgtgaaaattctatcatttaccgggccgttggaaatatgcggtttactgcactcacagatgttttccgccaccttcagcagcagtgactcgggggtaatttcaggatcataaataaaggtcagattcggcgaaacctgctttaactctgcgtcagcgcgtaaaatggcgcgggtgaccggcgtatcctgcgggccgatattggcatgcataaaggcatccggcagggtgcgatccagatagcgccagaaacgttttatgcgactatcgatttcgtcttgtgttagaattctaacataaggttgcagcagggcatcaaggtggccgaggaacaccggcatcgaagtgaccgacggcacatggtgataaagaatggtgagcatcgacagcgcatcgtcgaaatcttttgccggttccagcttcagccattccgaaccctgcgccagaaatttcgcgtaatcgggcagcacatagcgcggtttgtaaggcgcgttgccctcgaacatatcgcatatcacgccgtcatccagcgccgcacgcgcggcctggggtaaggcgggataaggcagagcgttttccgcctccagcgccagaaaatgtcgcttttgtgcggatgagagtacagggcttgtcacaatttgctggcaacgttgcagcatcgtttggggcgcagacgcgggcatgggctttcctcgggttccttgagtgaggcgggcagtgtaagaaatgccggatgcacgtcttttgatcctgatgggtgcgcagcggaaaaaccctggccctggtgctgaaaaagttgatctgaatctcatatcagttatgcaaatgtgaatgtcgttttcattaactgtgatgaatgtcgaagtgtcgtggcgggtgaatgttagaatactcacacacccgccggaataaatgttaaccggagaatgttatgactgatttaaccgcaagcagcctgcgcgcgttgaaactgatggatctgaccaccctgaacgacgatgacaccgatgcgaaagtgatcgccctgtgtcaccaggcgaaaaccccggttggcaacaccgccgcggtttgcatctatccgcgctttatcccgattgcgcgtaagacgctgaacgagcagggcacgcctgacgtgcgcatcgccaccgtgaccaacttcccgcacggtaacgatgacattgagatcgcgctggccgaaacccgcgccgccatcgcctatggtgcggatgaagtggacgtggttttcccgtaccgcgcgctgatcgccggtaacgagcaggtcggttttgacctggtgaaagcctgtaaagacgcctgtgccgcagcgaacgtgctgctgaaagtgatcatcgaaaccggtgagctgaaagaagaagccctgatccgtaaagcgtctgaaatcgccatcaaagcgggcgctgactttatcaaaacctccaccggtaaagtgccggtcaatgccacgccggaaagcgcgcgcattatgatggaagtgatccgtgatatgggcgtggaaaaaaccgttggcttcaaaccggcgggcggcgtgcgtacggctgaagatgccgcgcagtttctggctatcgccgacgagctgtttggcgctgactgggctgattcccgtcactaccgtttcggcgcgtccagcctgctggcaagcctgctgaaagcgctgggccacggcgacggtaaaagcgcaagcgcgtattaagtagttatttgccagaccacaggccgggtaaggcatcaccgccacccggcatgtcatcgtaacgccgggtggcgcgttgcttacccggcctacagactggccttcgactctttttcctcagggggttcccttgtttctcgctcaagaaattatccgcaaaaaacgtgacggcatcgcattaagcgatgaagagatccgcttttttattaacggcattcgtgacaataccgtttccgaaggccagattgcggcgctggcaatgaccattttcttccatgacatggcgattgaagagcgcgtctcgctcaccatggcgatgcgtgattccggcagcgtgctggagtggaaaagcctcaaccttaacggcccgattgtagataaacactccaccggcggcgtgggcgatgtcacctcgctgatgctggggccgatggtcgccgcctgcggcggatacattccgatgatttccgggcgcggcctggggcataccggcggcaccctcgacaagctggaagccattccgggcttcgatattttcccgaacgatcaacgcttccgcgagatcatcaaagacgtgggcgtggcaatcatcggccagaccagctcgctggcaccggcggataaacgtttttatgccacccgtgacattaccgccacggtggactccatcccgctgatcaccgcctcgatcctcgccaaaaaactggcggaaggtctggatgcgctggtgatggacgtgaaggtcggcagcggcgcctttatgccaacctacgaactctctgcggaactggcgcaggcgattgttggcgtggcgaacggtgcgggcgttcgcaccactgcgctgctgacggacatgaatcaggtgctggcctccagcgccggtaatgccgtggaagtgcgcgaagccgtgcagttcctcaccggcgaataccgcaacccgcgcctgctggaagtgaccaccgcgctgtgcgtggaaatgctcatttccggcaagctggcgaaagatgacgccagcgcccgtgccatgctgcaaaacgtgctcgacaacggcaaagcggcggaaatctttggtcgtatggttgcagcccagaaaggcccgaccgattttgttgaaaactacgacaagtacctgccgacggcaacgctgaccaaagcggtttatgctgataacgaaggcttcgtgtcagacatggacacccgcgccctcggcatggcggtggtatcgatgggcggcggtcgccgtcaggcctctgacgccattgattacagcgtcggctttaccgatatggcccgactgggcgacagcgtggacggtcagcgtccgctggcggtcattcatgccagagacgaaaacagctggcaggaagcggcccgcgcggtgaaagccgctatccgcatcgatgaccgcgcaccggcggaaaccccggtggtatatcgcagaattactgaataaccgcccggcgagcttcccgttacaggaagagttcgggtatactgatctgatcgcttttttacagcgcgcaaggtacggagaaactatgaaacgtgcatttataatggtgctggactcattcggcatcggtgcgactgaagatgcggagcgctttggcgacgtaggttcagacacacttggccacatcgcagaagcctgcgcaaaaggtgaagctgaccagggtcgtcagggtccgcttaatctgcctaacctgacccgtctgggtctggcgaaagcccacgaaggttccaccggcaagattgcggcgggtctggacggcaacgcggaagtgatcggcgcgtatgcctgggcgcatgaactctcctccgggaaagacacgccgtcgggacactgggaaatcgccggtgtgcctgtgctgttcgactggggctatttcagcaacgagaccaacagcttcccgcaggagctgctcgacaagctggtggaacgcgcaaacctgccgggttacctcggtaactgccactcctccggtacggtgatcctcgaccagctcggcgaagagcatatgaaaaccgggaaaccgattttctatacctctgccgactcagtgttccagatcgcctgtcacgaagagacctttggcctggataagctgtatgagctgtgcgaaatcgcccgtgaagagctgaccgaaggcggctacaacattggccgcgtgatcgcacgtccgtttatcggcgacaagccgggcaacttccagcgtaccggtaaccgtcacgacctggcggtagagccaccggcgccaaccatcctgaaaaagctggttgaagagaagaacggccaggtggtttccgtgggtaaaatcgcggatatttatgccaacgtcggcatcaccaaaaaagtgaaagcgaccggtctggatgcgctgtttgacgccaccgttaaagagatgaaagaggcaggggacaacactatcgtgtttaccaactttgtcgattttgactcttcctggggccatcgccgcgacgtggcaggctatgccggtggtcttgagctgttcgaccgccgtatgccggaactgctggagctggtgggcgaagatgacattattatcttcaccgctgaccacggctgcgatccgacctggaaaggcaccgatcacacccgcgaacacattccggtactgatctacggcccgaaagtgaaaccgggctcgctcggtcaccgtgagaccttcgcggacatcggtcagacgctggcgaaatactttggcacgtccgatatggaatatggcaaagccatgttctgatacccgttgccggatggcgctacgcttatccggcctacgaggaagcgtttgtagttatgtaggccgggtaaggcgcagccgccacccggcaaaattttaaaaaggaatgaaagatggctaccccacacattaatgcagaaatgggtgatttcgctgacgttgtgctgatgccgggcgatccgctgcgtgccaagcacatcgcggaaaccttcctggaagacgcgcgtgaagtgaataacgtgcgcggcatgctgggctacaccggtacttataaaggccgcaaaatttccgtaatgggtcacggcatgggtatcccgtcctgctccatttacaccaaagagctgatcaccgatttcggcgtgaagaaaatcatccgcgtcggctcctgcggtgcggtacgtgccgacgtaaaactgcgtgacgtggtaattggtatgggtgcctgcaccgattccaaagtgaaccgtctgcgttttaaagatcacgacttcgcggccatcgcggacttcgacatggtgcgtaacgcggttgacgcggctaaagcgctgggtgttgatgcgcgcgttggtaacatcttctccgccgatctgttctacaccccggatccgtccatgttcgacgtgatggaaaaatacggcattctgggcgtggaaatggaagccgcgggtatctacggcgtggcggcggaattcggtgcgaaagcgctgaccatctgcaccgtgtccgaccatatccgtacgcacgagcagaccactgccgctgagcgtcagaccaccttcaacgacatgatcaaaatcgcgctggaatccgttctgctgggcgataaagagtaagatctgttgtgccgggtggcggcttcgcctgacccggcctacggtttaccaggcccgctaagcgtatcgcaagcgggctttttattagcgcactgccccggcaatccacgccgacaactcccgcagttctttttcctgctcaggatagtccgcaatcaacatctcacacacctgttgcagccgatcggcgcgatacagacagccctgcaaacgtgtcgccagcgcctctaacggcgcggggttcaggctgtcggtgaacacctgcgtgcgggtgatatggcctttttccacgtcgaaatgcagctccacgccgccccaggtaaagcgctcgtccagcaaatggctgaaggccggggcctggccaaagttccattcccaactgctctggcgggcaaaggtttccgcgaagttcggcagatccggcgtcttgtccggagagatgatctccgcgtccacgctttcaccgtagtgctcaaaaaaggcgcgggtgacagcttcgcagatcgcctcatgggtgatgccgggcagcagatcgacaaggttcgccacccgcccgcgcaccgaggtaatgcctttcgcctgaagctttttcttgtccgggttcaggtaattcgccagacggctgagatcggcattcagcagcagcgtgccgtgatgaaaaccacgatccggcgtctcccggtaggcggagccggacactttacggtcgccgtccggggttttcaccaccagatcgttacgcccggaggcttccgccgtcgcgccaagggatcgcagcgcgtttaaaacgatggccgtggaaatgcttttatcgtattccggcttacccgccataaaggtaaagcaggtattacccagatcgtgaaacaccgcgccgccgccgctgctgcgacgggcaaggcgcacatgatcctcttccatacgccgggtattacactctttccacggattctgcgcccggccaatgaccacggtatccgcattgcgccacaggaacagcacgcgctgggtggcgggcatctggcggaaaatgcactcttccaccgccaggttaaaccagggatcgtaagagtcagaaatcaataaacgcagggtggacatagccagtctcctttatacggtgtcccgtcagggttcctttttatcacgctcttcttcttccggcaccgacttgctggccgtcagcaggaagggggattgctgccagcgggtgcgtttaccctgcaacagggtgcgggtcagcaccacgccgatggcgagggagagcagcagcatcaggcgtaaaatattggtggtgttatccacctgtttcgcttcggtcgccagcgtatgggtatccagcgtcaggcgcagatagcccagcgggccatttttacccggcaccggttcgacaatttgctggttaaaatagccgcccgcttttttgccatccagcgccagccggtcgcgtacatcgacgctttcgcccgcgcggaccaccagatcgccctgttcgtcatagacgcccgcatccagaatgcggctttcgtcggttaactgacgcaggatctggccgatacgtttttcgtccggcgtttcactgcgcatcagcggcgcgagattcagcgtcacctgacgcgccagcgtgcgggccagctcctccagctgcggattgcgcgcccgctggtggctctggctgaaccagctggccccctgcatcagcgccaccagaagggcgagacagatcaggacaatcacggcgcgatgcagccggaattttaattttgcgcgagccatagtctacctgttgaaaattttacgcttccgctgcggcataacggtccgcgctttgaatgcatggtcgatgcaccgggtgatgctacccatgataaacccttgtgtaatgacaaaggtcgttacgattgttgcatggggttgggaggagggcaaggtgagggggattgcttaaatgttgtccgggatgagcgagaagcggatataatcatcaggtgtaatccgcttaaaaacaagtgcctgtgttaatttgtaagcgaagccgttaagcaaaaacaatgtttaaataattagtggagagatcatgggcgtagagttccatataacacgagctgatttttgggcggataatgaagaagcccaaataacgcctgaggagtggctttcccttatcgatagcgacagcgaattaacgataaaccttaaaaatggcgactatcatgctttgtggtcaggtgcttcatcgcacgatgaggcatggcttgactggagcgatggcaatatctacaccaaatggccagacacgcagctatacagaaagatgttagatatcgctgggcgcctcaacgctcgggtaatggacgacgatggtaatatttacagcgccccatctgactgggagtatgaaccttcttctactgattaacgtccgcttcgggcgtgaaacagacgagctaactgagttgatggtccgccatgagcgaggaacagacatttacttaactggatgccaaaagacttcatactatagctcatccattatggttgacttgaagcggcagattattcaagctgcgaagctgatcattatcatacagatggttgagtcgggagttttcaggaatggaaagacatcgcccacatggtcgtaccgtaaccgcattagaagcagatgtacttaaacttcgggcactagaaatggtcttggtgcttttctatgtggaaaacctgaaagattttattagcagttctgttaacgtcacaaaaaggttaagaaaaattattgacagtacgcaatctacagcaaatgaccaaaagaaaattagctttaaagaagcacatgaattactcctttcggaaggagtcataacacaagaagaaagcttacaattgatagaaatgattgactaccgtaatactataggccatgagatccacagaataacgatagatgttggagcatacgctaatcttggtgagcaggatcttcctaacggacataaaatagcacaatataattactcagctgtccagcacatacagaatcttagaaaaaatatagaagaaaaaatgatggataaatcattttgctttgaactatctttcgacgctttggcatttaatgccgccgagcaaacatatcttaaagaaattaagagattaaagaaaaaagttaacgaccaaattaataagttgaacgttactatagatgctacgaatgaaataatcagaagaattccgcatgaagttatggatgctgtacagcccggccatccgaaaaacaccaagaacaatggcacatttagcccagaaggtacgaaaggaatgttcatgttatatgatgcaaaagccagtccgttggcagttgcttatataatgaggatatcatatcgcactgctttaagatggtataaaaagtggagtgaaaatcataaaaaataagtaaggcggatgaattttaaattaaacaccatcgtatataaatattgctttatttcatgtgggttctttattttatcttttttttgacatattaatgtatatggattgaaattacctattagcatccccatgatagcttcactcttatttgagattttcactaagttattgacgggatttgatacttgtaatgtccgtttccaggcaagaatcggacacgtaacctgatttaaagttccgctgcgggcgagggcggccattatatttagtgctactttctaacattaatgcacatcaagaaaaattaaagagataacagaccgatttgaacaaggcctgttatccggaatgtttattaatatgaggtatttttttcaagaatatacagattctgttaatccatccaaacattctataacaaaacgcttggcctcttggttatctctcactaaggtcataattttagtttcataaaatgcacggtttggacagttaagcctgcgaataattttatctatcataccagttcgcctaattgaatatctttctatcaagaaactaacgtcttttcgttcaagagcatcttcataaatcgatagctcattgttataaatatctccagcattgattgatacggttttattttcgaagccggctctatgacttggtattaactgattaaacatccatcttactgatttattaaccgcaaggctacataaatccttcttttttgaagaatcaattaatacggtaagaatatctttcttaatatcattcataactgaatcatcaatttcaaaaatatcaccgtacttttttataaagaactctatcattacagggtgatagaatattgattcaatagagtgatatttaagagtaaagataaaatcactttttaagctatcaatttcttctgctttcttattatcattgtcaaccaaaccaaatgcattaacccatcctagcttatcattacctctgatgcctctgaccgaaatagctacatcttcacacccctccttcgggattaacgaaacatcaggaaaaactgatttataaagtcctatatcaagacttgagtttattccctctatgaaaataactttctcttttgcaccgataatatctttttttatgtgatcaggaattgaaccgggatctcttataagttccgtttcccacgaggttgcgatttcagaagtatatttacacgactttaccaaaaggatttgtgaattatccatatctgaagcaaggcctatgtcgtgtgttgaaacaatgaaaaagcaatcaggcctgattgctatcagttctgatagcaagggagatgaaacagacctatgtaaatgcctttcaggctcatcaataataaaaagagtacctggcaatgctgatataacatcagcggatatagttatggcatttttctcaccatcagataattgagatatagagtaaattgctggcggattatattttgaattcactgctgtaatattatcttcatcatcgtgttctatagtgataggcattcctgatgatattaaaactgaattaattatttctttaggtgacacactaaccttcagcgctccatctatgtctcttgcgtctactttatcggcaacatctctatttcttctattaattgctttttttaatctaatgacaggaagtttgctttgtcttgcatcatcgactttccaacgagaagtgtttgaatatcttacattgctttgaagatattctaaagtagaagcaaactccgaattcgacatatcaataaccgatgtgtcaaaccaaatttgcctatgtgcagatatcaatacgatattattataatctcctaggttttttagtacgtgataaattagtgatgacttgccagcgccgttagctccaagaatgaaaagaacctgtccttgatagataggcaataatctaccttcaatgttctctgaaggaataggaatattaacatgcttttccaagtttttctcctaaactaggtagagctactattatttatatcgatccattgtattctaatattttggcagtcgccaccttactttacttacctcttgtagctagagttatctgctcgtattgaatcggcatgtctatattttttgataggaccgtgtctttaaacaataactcagttagctcgcccgctcctgccacaaagccgtccttgaaccaggtgccagaccattaccgatcccaggatattctacgggtcgtacagacatcagcccatctttcaaacacctttgcgagccgctacgcaaaccgtacagctaaatccgcttgccgttaaccgactccggcagtagcatcttcccgcacctgcaaaatcaggtgccgggattagcctccacgaattgttacaggcgacataatttttatgtcgtgcgttcggctacacctcaatggtgggccgggcgagggcgtcgcaagacgcgccggtttcctgtaacaccggtaaggctaacctcgtccggttccgccacccgtgggattagcctctccgctggcggaatattaaaccgttacaggagactgccttatggctaccatccccgatcagttgtacccgttacttaccgttccttttactgctgacaccgatttcaccgtgctggcggatcattgcgagcacttcgccgaagcgctgattgaaagcgacgatccggcgctgcgcctcgccatgtgcggacggctcaatgcctgcctgatgctgctccagcccacgctgaatgaggtgataccgccacatctggttgcggcgctcacggtggatacgccgcctgcggaaccgccccgtttcgaaccggaatctgacctgttatgtgaatactgtcttacgttaacgcgcgtgctcaacagccagtcgctgccgccggacatggaaaaaaccctcaccgggctgctctgtgaactggtgtggtatttcacggacatcatgaaagccccgcgctgggtgcgaacgcaggcgggcatgcaggaactggaggcgtagcgtatcggtaaaagccctgccgggtaccctctctccgggcccggcagcactgcacaattccacatgaagctgttgccagaagcgatggttacagggtagcctcatgcgttattttccttatacccgtcatacttcaggttgcaggtgtgttggctttcctcgttcaccccggtcacttacttatgtaagctcccggggactcactgcgtcgccgccttcctgcaacccgaattattcagggtaaagacaatttccgacgcgaacgtgtaaacaggagcattaatgcttaacagtctgacctggtgcgatctgcctgaagaggtttctcagtggcctggattgccgctctcgttaagtggcgatgaggtgatgccgctggattatcatgccggtcgcagcggctggctgctttacggtcgcgatctgaataaagcgcgcctgacggagtatcagcgtaagctgggcgcagccatggtgattgtggcggcctggggcgtggatgagtaccaggtgatccgcctggcaggctcgctgacgccgcgcgccacccgtctggcgcacgatgccgggctggacgtcgcgccgctcggcaagatcccgcacctgaaaacgccaggattactggtgatggacatggactccaccgccatccagatcgaatgcattgatgagattgccaaactggcgggcaccggcgaaatggtggcggaagtcaccgaacgcgccatgcgcggcgaactggatttcaccgaaagcctgcgcagccgcgtggcgaccttaaaaggggccgacgccaatatcctgcgccaggtgcgcgatgatttaccgctgatgccgggcctcacgcaactggtgctgaagttacagtcactggactggaaagtcgccattgcctccggcggtttcaccttcttcgccgattacctgcgcgacaagctgcacctgacggcggtggtcgccaacgaactggaaatcatggacggcaggctcaccggccatgtgctgggcgacatcgtggatgcgcagtacaaagcgaaaacgctgaaacgtctggcggaaaaatatgacgtgccctttgagcagaccgtggccattggcgatggcgcaaacgatctgccgatgattaaagcggcagggctgggcattgcctatcacgccaagccaaaagtgaacgaaaagacagaagtgacgatccgtcacgctgacctgatgggcgtgttctgcatcctgtcgggcagcatgaatcagaaataacgaggtaaaagtggcaaaagctccgaaacgcgcatttgtatgtaatgaatgtggtgccgattatccgcgctggcaggggcagtgcagcgcctgtcatgcctggaacaccatcaccgaagtgcgtgtggcggcatcgcccgtggttgcccgtaacgagcgcctgagcggctatgccggtaatgcgggcggctcgaaagtgcagaagctctccgagatcagccttgaggaattgccgcgcttttccaccggctttaaagaatttgaccgtgtgctgggcggcggcgtggtgccgggcagcgcaatacttatcggcggcaaccccggcgcgggcaagtccacgctgctgctgcaaacgctgtgcaagctgtccgagcagatgaaaactctgtacgtcaccggggaagagtcgctgcaacaggtggcgatgcgcgcgcaccgtctgggcctgccgacggcgaatctcaatatgctgtctgaaaccagcattgaagacatctgcactatcgccgatgaagagcagccgaagctgatggtcatcgactccatccaggtgatgcatatggcggatattcaatcgtcgccgggcagcgtggcgcaggtgcgcgaaggggcggcctatctgacgcgctacgccaaaacgcgcggcgtggccattgtgatggtcggccacgtcaccaaagacggctcgctggccgggccaaaagtgctggagcactgcatcgactgttcggtgctgctggacggcgatgccgattcccgcttccgcacgctgcgcagccataaaaaccgcttcggcgcggttaacgaactcggcgtgttcgccatgaccgagcagggcctgcgcgaagtgagcaacccgtccgccatcttcttaagccgtggcgatgaagttactgccggcagttcggtaatggtggtatgggaaggcacgcgcccgctgctggtggaaattcaggcgctggtggatcagtcgatgatggctaacccgcgccgcgtggccgttggtcttgagcaaaaccgtctggcgattttgctggcggtgctgcaccgtcacggcggcctgcaaatgtcggatcaggacgtgttcgttaacgtggtcggcggcgtaaaagtcaccgaaaccagcgcggacctggcgctgctgctggcgatggtctccagcctgcgcgaccgcccgctgccggacgatctggtggtgttcggcgaagtggggctggcgggcgagatccgcccggtgccgagcgggcaggagcgtatctcggaggcagccaaacatggcttcaaacgcgccatcgtgcctgcggccaacgtgccgaaaaagccgcctgccgggatgcaagtctttggtgtcaagaagctttctgatgcgctatctgtttttgacgacttataatgatttattaagcggaaactaaccgcactgatgcaggaggcacctatgtcgtcatttgattacctgaagaccgcgatccgccagaaaggctgcaccctgcagcaggtggcggatgccagcggcatgaccaagggctacctcagccagttgctcaatgccaaaatcaaaagcccgagcgcgcagaagctggaagcactgcaccgctttttagggctggaattcccgcgccgccgtaaatccgtcggcgtggtgttcggcaagttttatccgctgcataccgggcatatctatctgatccagcgtgcctgtagccaggtggacgaactgcatatcatcatgggctatgacgacacccgtgaccgcgcgctttttgaagacagcgccatgtcacagcagcccaccgtgccggatcgcctgcgctggctgttgcagaccttcaaataccagaagaacattcatatccatgctttcaatgaagagggcatggagccgtatccgcacggctgggacgtttggagccggggcatgaaagcctttatggaagagaagggcatcgagccgaaccggatctacacctccgaagcgctggatgcgccgcagtatctggaacatctgggaacggaaacgatccttatcgatccggaacgtacctttatgaacatcagcggcgcgcagatccgtgagaacccgttccgctactgggattacatccccaccgaagtgaaacctttctttgtgcgtaccgtcgccattcttggtggcgagtcgagcggcaaatccacgcttatcaacaagctcgccaacatctttaacaccaccagcgcctgggaatatggccgcgattatgtgttctcgcatctgggcggcgacgagatggcgttgcagtattcggactatgacaagatcgcgctgggccacgcgcagtacattgatttcgcagtgaaatacgcgaacaaagtggcctttgtggatacggattttgtcagcacccaggcgttctgtaaaaagtacgaggggcgcgagcatccgtttgtgcaggcgttgatcgacgagtaccgttttgacctggtgatcctgctggaaaacaacaccccctgggtttctgatggtctgcgcagcctcggcagctcggtggacagaaaagagtttcaggcgttactggtgtcgctgctgaagcaaaacaatatcgattttgtgcatgtggaagaggcggactacgacgcgcgtttcctgcgctgtgtggatctggtgaagcagctgatgggcgagcagggctaaataaatgcccctttcccgacgggaaaggggcaccggcattacttcgaaatacgcttgtacttgatacgcttcggctccagcgcgtccgcgccgagagtgcgtttcttgtactcttcgtattcggtaaagttaccttcgaagaattccactttgccctcatcctggtaatccagaatgtgggtggcgatacggtcaaggaaccagcggtcgtgcgagatcaccatcgcgcagcccgggaactccagcagggcgttttccagcgcgcgcagggtttcgatatccaggtcgttggtcggttcatcgagcagcagcatgttgccgccaacctgcaacagcttcgccaggtgcagacgaccacgctcaccgccggacagttcgcccacgcgtttaccctgatcaatccctttaaagttaaagcggccaacgtaggcgcggcttggcatctcggtgttgccgatacgcatgatatccagcccgccggacacttcttcccacacggttttgctgttatccatcgcgtcgcggaactggtcaacggacgccagcttcacggtttcacccagctcgatggtgccgccgtctggctgctcctgaccggacagcatgcggaacagcgtggatttacccgcgccgttcgggccgatgatgccgacgatcgcgcctttcggcaccgagaagctcaggccgtcgatcagctgacgatcgccgtaggatttgctcaggttggtaacctcaacgactttatcgcccagacgcggtccaggtggaataaagagttcgttggtttcgttacgtttctggtattcggtgctgttaagttcttcaaagcgtgccagacgcgccttacctttcgactggcggcctttcgcgccctgacgaacccactccagctctttctcaatcgacttacgacgcgccgcttcctgagaagcttcctgcgccagacgctgatctttctgctccagccaggaggagtagttaccttcccacggaataccttcaccgcggtcaagctccaggatccagcccgcaacgttatcaaggaagtaacggtcgtgggtgatcgccaccacggtgccttcgaagtcgtgcaggaagcgttccagccaggcgacggattccgcatccaggtggttcgtcggttcgtcgagcagcagcatgtccggcttttccagcagcagacggcacagcgcgacgcggcggcgttcaccaccggacagtttttcgattttggcatcccagtccggcagacgcagcgcatcggcggcgcgttccagctgcacgttcaggttgtggccgtcatgcgcctggataatttcttcaaatttaccctgttgcgccgccagcttatcgaagtcggcgtccggctcggcgtacttcgcgtacacttcgtccaggcctttcagggcgttaaccacttcggcgaccgcttcttcaacggactcgcgcacggtatgttcaggattgagtttcggctcctgcggcagataaccaattttcaggccaggctgcggacgggcttcaccttcgatgtcggtatcgatgccggccataatgcgcagcagggtggacttaccggcaccgttgagacccagcacgccaatttttgcgcccgggaagaaactcagcgagatatttttcaggatatgacgtttcggcggaaccactttgccgacacgatgcatggtataaacgaattgagccacgttggacttcgcctcttttatcgggatgtgaatggtctttaactgcgcagtgtagcggttttcacggcgcaatcccagcaggcccgggcgagagtgttaaatcacaccgaaaaggtaaaaaagtgtccggggcgtggcgcgataggggatgcctggttagcataaagtattcgcgcgcatgatgcggtgaagcgttttatttataagaggaaaagcctgtgcagaaagcaaaacacgtcgtctggcagatgctggtggtgggcagctgtttactgaccctcagccacacggcacgcgccgattcgctggacgatcagcgtaaccgttatgcgcaaatcaagcaggcgtgggatagcaaacaaatggacgtggtggcgcagctgatgccgaccctcaccgattatcccctctacccttacctggaataccgccagattactgacgatctgatgaaccagccggcgatcaaggtcagcaattttattcagtcaaacccaacgctgccgcccgcgcgtagcctgcaaaaccgttttgtgaacgagctggcgcggcgtgaagactggcgcggcctgctggcgttcagcccgcaaaagccgggcaccaccgaagcgcaatgtaactattactacgccaaatggaataccggccaggccagcgaagcctggcagggcgcaaaagaactctggctgacgggcaaaagccagcctaacgcctgtgacaaactgttcggcgcctggcgcgcctccggcactcaggatccgctggcctatctggaacgtatccgcctggcaatgaaagccgggaatacccaactggtgacggtgctggcgaatcagatgcccgcggaataccagaccatttcgacggcgattgtgacgctggcgaacgatcccaacagcgtgctgaccttcgcccgcaccaccggggccaccgattttacccgccagatggcggaagaagccttcgccagcgtggcgcgtcaggatgtggaaaatgcgcgcctgatgctgccgtcgctggtgcaggcccagcagcttaatgaagatcaaacccaggcgctgcgcgatattatcgcctggcgactgatgggcaacgatgtcaccgacgagcaggcgcgctggcgtgacgatgccattatgcgtacccagtccacgtcgctggtggagcgccgggtgcgtatcgccttagggcagggggatcgccgcgggctgaatacctggctcgcccgtctgccgatggatgccaaagagaaagacgagtggcgctactggcaggcggatctgctgctggagcgtggccgtgaagaagaagcgaacaccattctgcgatccctgatgcagcagcgcggtttctatccgatggtggcggcgcagcgtctgggggaagactatccactgaaagtggataaagcgcccggcaatatcgatccgacgctggtacagggcccggaaatggcacgcgtgcgcgaactgatgtactggggtctggataacaccgcccgcagcgagtgggccaatctggtcaccagccgcaccacgcaacagcaggcgcagctggcgcgctatgcctttgaacgtcagtggtgggatctgagcgtgcaggcgactatcgccggtaagctgtgggatcagctggaggagcgtttcccgctggcgtataaagatctctttgagcgttataccagcggcaaagatatttcccagagctacgccatggccatttcacgccaggagagcgcctggaacccgaaagtgcgctcgccggtcggcgccagcgggctgatgcagatcatgccgggcaccgcgacgcatacggtgaagatgtttaatattccgggctacagctcgccgggccagctgctggatccggaaaccaatatcaacatcggcaccagctatttgcagtacgtgtatcagcagtttggcaataaccgtatcttcgcctcggcggcttacaatgccggtcccggtcgggtgcgcacctggcttggcaacagcggtggacgcattgacgccatcgcttttgtcgagagcattccgttctcggaaacgcgtgggtatgtgaaaaacgtgctggcctatgacgcctattatcagtacttcatgggcggtaaaccgacgctgctcacggcgacggaatgggggcgtcgttactgatctgccgggtttgtgttatgctgctgtactcgttgatgagtatggcggtatgacatgacgcagcaatctccttattcagcagccgttgccgaacagcgtcaccaggaatggttgcgcttcgttgagctgcttacacaatcctgcgaacaggatttgcatcttccgttgctcaatttgatgctgacgccggacgagcgcgaagccctggggacgcgggtacggatcattgaagaactgttgcgcggcgaaatgagccagcgcgaactgaaaaatgagctggggaccggcattgcgaccatcacccgcggctcgaacagcctgaaggcggcgcccgccgagctgcgtgaatggctcgaaaaggcgctgcttaaagatcagcgataaacgtcgttgtgaaacggacttaacgccaggatcaccgcctgatggtagacgctggtacgcgtcagctttccggcggtgaacacgccaattgccccttctttacgtccaatctcatcaatgccggtgaactgcgacatcaccgggccaagcgcttccccggcgcgtacatgctcaagaatgacggcaggcagcggcagggtggcggaacgcgcttctccgcgctgatcgcggctttcaatcaccacccagctgaaggtgctgtcatcgtcaattcccgcttctatcgccacccagaaatccgcctgcggcctttcacggcgggcgttttcgacacgattacgtgcgccagcccgcgtttctgcgctgccgaacggctgttccggcacgccgctctcgacggcgacagactccatatggcaggatccttcgccgaaaatctcgtgaaatgcgtgcagaatagccttaattttcgctggattgctggtagctgagacaacatggtacataatcaatatcactcagatttataaatttgccccgcagtataatggaaaaaacgcatgttacaggtataccttgttcgccacggtgaaacgcagtggaacgccgagcgtcgtattcaagggcagtcagacagtccgttgacggcaaaaggtgagcatcaggcatggcaggtgggcgaacgggcgaaaacgctcggtatcacccatatcatcgccagtgatttagggcgcacgcgtcgcacggcggaaattatcgccgatgcctgcggctgcgacattatttttgacgcccgtctgcgtgagctggatatgggcgtgctggaaagccgccatatcgattccctgacggaagaagaagagggctggcgtcgtcagatggtcaacggcaccgcagaggggcgcattccggatggcgagtccatgcaggagctgagcgaacgtatgcatgcggcgctggcagcctgtctggatctgccgaaaggcagccgtccgctgctggtgagccatggtatggcgctgggctgtctggtgagcaccattctggggctgccagcctgggctgaacgccgcctgcgtctgcgcaactgctctatttcgcgtatcgattaccaggaaagcgcgtggctggcttccggctgggtggtggaaacggccggagacgtctcgcatctggatgctccggcactggatgagctacagcgttaacgacgcaccgggatcaggtattcgcagcgcagttcaatcggccgctcctgattccgggcctcatcctgtgggaagaagcgctctatatccagccccttgcggcgggtgagatccagcatcggcatacaggtgccgtagatggtcaggataaattcctgtaactcattgcccggcccttcataagtgaacatcacgtattcaccgccttccagcgtcaccggatgggcattttgcaggtgaccgttcgccatttccggcgtcacggcggtggtgtagaacacctcctgctcgtcatccttttcgctgcccggacgcgtttcatgcaggccgtacagttcggctggcaactgcggcgagttgcctaagaattcccgccagaactgaatacgcatgtcgttacggaagcgcgaaatctcctccagcgagcaggtatagctctgggtggtgcccaccaggtccatcgtcggcagcgtaacaaactgatactcgggcatatggaattcgcccagacgcagcggagggcggatgccgtaggcgctccagtccggggcgcggcggtatagtgctggcgtcagattaaattgctttttgaacgcgcgggtgaaggtttgctgcgagtcaaaacggtattgcagggcgatgtccagaatcggacgtgctgttaaacgcagcgccaccgccgccttggataaccggcgtgcgcgaatataggcacctatcgcatgacctgtcacatccttgaacatcctttgcaaatgccacttggaatagcctgctttcgccgccacattatccagagcgagggattgatccagatgcccctccagccagacaagcagttcgcgaataatcccagcctgatccatattgtgtcctcatccttatttagcgggtgcctgatactaaggtagcggataatagcatttttcgttcttttagcattcagtgttttttttgcgcataaatgcttttcatggttgaatttattctgatttttcgtaattcagtgatttatagctattttcttctgtaacggacaataatcactcaacgtaatttttatcaatggtaacaatatgaaatacaagcgtttgctgctgtgcctgttcctgtgcgctgccggacagtcggttcaggctgaacaaattggctctgtagatacggtatttaaaatgtttggcccggatcacaagatcatagtggaagcctttgacgatcccgatgtgaaaaacgtcacctgttatctgagccgcgcaaaaacgggcggtatcaaaggcggtctggggctggcggaagatacctcagacgcggcgatttcctgccagcaggtcgggccgattgagctgagcgaaaaggtgaaaaccggtaaggcgcagggcgatgtggtgttccagaaacgcacctcgctggtgttcaagaaattgcaggtggtgcgtttctacgacgcgaagcgcaacacgctggcttacctgacgtactcggataaagttgtggaaggctcgccgaaaaacgccatcagtgccgtgccgattatgccgtggggtaaatagcaggctgcacggatgccgtggaaacgggtccggatggagaaaagaaaaacggcgcatcatgcgccgtttttattcttattccgctaaatcgccgcagaaacggtaaccttcaccgtggatggtggcgataatttccggcgtgtccggcgttgattcgaaatgcttacgaatgcgacgaatggtcacgtcaacggtacggtcatgcggtttcagctcgcggccggtcatcttcttcagcagatcggcgcgggactggatcttgcccggattttcgcagaagtgcagcatggcgcggaattcgctacgcggcagcttgtactgctcaccgttagggctgatcagcgagcggctgttgatatccagctcccagccgttgaacttgtagctgtcaacggtgcgacgctcttcgctgatcgcgctcagattcatcgtacgggacagcaggttgcgtgcacggatggtcagctcacgcgggttaaacggtttggtgatgtaatcgtcagcgccgatttcgaggccgaggattttatccacttcgttatcacgaccggtcagaaacatcagggcgacgttcgcctgctcgcgcagctcacgtgccagcaacagcccgtttttaccaggcaggttgatgtccatgatcaccagattaatgtcattttcggagaggatctgatgcatctcagcgccatcagtcgcttcaaagacatcgtagccttctgcttcgaaaatgctcttcaacgtgttgcgtgttaccaactcgtcttcaacaataagaatttgcggggtctgcatgtttgctacctaaattgccaactaaatcgaaacaggaagtacaaaagtccctgacctgcctgatacatgtcgcaaattaacatgcacggcgtaacatgactaaagtacgtaattgcgttcttgatgcacttaccatcaacgtcaacaacatcattagcttggtcgtggttactttccctttggacccgacagtgtcaaaaacggctgtcatcctaaccattttaacagcaacataacaggctaagaggtgccagacacccaataaaactacgcttcgttgacatatatcaagttcaattgtagcacgttaacactttgatgaaatattcgtagctttatatgagccgctttcacaatctatcaataaaccaaccagttgcaacagtaaattaataagtgttgtgaatccgaaaagagataagcatttatggcataattagccagcataaacaggagcctgcactgcttctgttaacataaaatcaggtagtcaatctatgcaacagtgtagttctttttaagcataccggacgctgatttcagtgatttctgttgcaaaaatgtaaatttgcatcgcgtaatatcttgacgaaagtggtcttgcagaaggccaggcgtattaaaagagagtcccacatgcaggtatccatcatattagtttcacccgcccgcgcggaaaatgtcggtgcggcggcacgcgccatgaagaccatgggctttactgatttgcgcattgtggacagccgcgcgcatctggaggaaggggcgcggagagtggcgcacggatccggcgatgtgcttgataatgctacggtttatccaacgcttgaagcggccctgcacgatgtgcagtttaccgtcgcgaccaccgcccgcagccggtcaaaattccattactacgccacgcctgccgaactggtgccgctgatgcaggagaaaagccagtggcttcatcacgccgcgctggtgtttggccgtgaagattctggcttgaccaatgacgagctggcgctggcagatgtgttaaccggcgcgcctatggtggccgattatccgtcgctcaatctggggcaggccgtgatggtctattgctatcagttaacaactttaatgcaacaaacggccgccacgcccgacgttatcagtgacgagaaccagttacgcgctctgcgtatacgcgcgcgggcgttactggaaaaactgggtgtcgacgacgacaccaagatggtcgactggctggaacagcgtattggtctttttgagcagcgcgacacggcaatgctgcaccgtttgctgcatgatatcgaaaaaaagctcgccggttaaaagtttgagatattcctttatggcagtcagatcgactgcctgcttgccacactgtggcgaattttcagcaaaatctgcgcacaaacagcgtgagcggcccgccagtggaaaagtcgtaaaattaaaaataaattgacttggcagggcagatactttaaccaatataggcatacaacacagacagataataattacagagcacacaacatccatgaaacgcatcagcaccgtcaccattattacgacaaccaccattacaacaggtaacggggcgggctgacgcgcacaggaaacacaggaaaaagcccgcacctcaacagtgcgggcttttttttcggctaaagatcaaggggtaattccatgcgagtcttgaagttcggcggtacatcagtggcaaatgcagaacgttttctgcgtgttgccgacatcctggaaagcaatgccaggcaggggcaggtcgccaccgtgctgtctgccccggctaaaatcaccaatcacctggtggcgatgattgaaaaaaccatcagcggtcaggatgccgtacctaatatcagcgacgcagagcgcatttttgccgaacttcttcagggtctttccgacctccagccagatttccctctcacccgcctgaaaggcgttgtggatcaggaattcgcccagatcaaacatgtactgcacggcatcagcctgcttggtcagtgcccggacagcatcaatgcctcgatcatctgtcggggtgaaaagctctctatcgccattatggctggattgctggaagcgcgcggtcataaagtgacggttatcgatccggtggaaaaactgctggcggtcggccattaccttgaatccaccgtcgacatcaccgaatccacgcggcgtatcgccgccagccgcattcccgcggatcatatggtgctgatggcgggctttaccgccggtaatgaaaaaggcgagctggtggtgctggggcgcaacggctctgactattccgccgcggtactagccgcctgtttgcgcgccgactgttgtgaaatctggaccgatgtcgacggggtctatacctgcgatccgcgccaggtgccggacgcccgcctgctgaaatccatgtcctatcaggaggcgatggagctgtcatacttcggcgcgaaagtgttacacccgcgcaccattacgccgatcgcccagttccagatcccgtgcctgattaaaaataccggtaatccgcaggcccccggcacgctgattggcgccagttccaatgaagacggactgccggtaaaaggcatctctaacctcaacaatatggcgatgttcagcgtctccggccccggcatgaaaggcatggtcggcatggcggcccgtgtgttcgccaccatgtcccgcgccggtatttcggtagtgctgatcacccagtcctcctccgaatacagcatcagcttctgcgtacctcaggcggactgcgcccgcgcccagcgcgccatgggcgaagagttctatctggagctgaaagaaggcctgctcgaaccgctggcggtcatggagcggctggcgatcatctccgtggttggcgacggcatgcgtaccctgcgcggcatttcggcgaagttctttgctgcgctggcacgggcgaacattaatattgtcgccattgcccagggctcttccgagcgctccatttccgtggtggtcagcaatgacgatgccaccaccggcgtgcgcgtcacgcaccagatgctgtttaacaccgatcaggtgatcgaagtctttgtggtcggcgtcggtggcgtcggcggggcgctgctggagcagctgaagcgtcagcagggctggctcaagagcaagcatatcgatctgcgcgtctgcggcgtggcgaattcaaaagcgctgctcaccaacgtgcacggtctggatctggaaaagtggcaggctgagcttgcggaagcgaaagagccgtttaaccttggccgtttgatccgtctggtgaaagagtaccacctgctgaacccggtgatcgtcgactgtacctcaaaccaggcagtggccgatcagtacgctgatttcctgcgggaaggtttccacgtggtgacgccgaacaaaaaagccaacacctcgtcgatggcctactaccacgagctgcgcaacgccgccagcaaatcgcgtcgtaaattcctctacgacaccaacgtcggcgcgggtctgccggtgattgaaaacctgcaaaacctgcttaacgccggtgatgaactacagcgtttctccggcattctctccgggtcattgtcctttatcttcggtaagctcgatgaaggcgtgtcgctgtcgaaagccacccgcgtcgcccgtgaaatgggctataccgaaccggatccgcgtgacgatctgtcgggtatggacgtggcgcgtaagctgctcatcctggcgcgcgaaaccggacgcgagctggagctgtctgacattgtgatcgaaccggtgctgccggaaagcttcgacgccagcggcgacgtggagagctttatggcccgtctgccggaactggacgatgccttcgccgcccgcgttgcgaaagcgcgggatgccggaaacgtgctgcgctacgtgggcaacattgaagaagacggcgtctgccgggtgaagatcgccgaagtggacggcaacgatccgctgtataaagtgaaaaacggcgaaaatgcgctggctttctacagccactattatcaaccgctgccgctggtgctgcgcggttacggtgcgggtaacgatgtgacggcggcgggcgtgttcgccgatctgctgcgcaccctgtcatggaagttaggagtttaacatggtgaaagtgtatgccccggcctccattggcaacgtgagcgtggggtttgatgttcttggcgcggcggtatcgccggtcaacggcgagctgctgggcgactgcgtcagcgtcgaggcggcgggggaattctcgctgaccaaccaggggcgcttcgtcagcaagctgcctgccgaaccgcgtgaaaacatcgtctatcagtgctgggaacgtttttgccaggagatcggcaaaaccattccggtggcgatgacgctggaaaaaaatatgccgattggctccggcctcggctccagcgcctgctcagtggtggccggcctgatggcgatgaatgaattctgcggcaaaccgctcagcgatgcccgcctgctggcgctgatgggcgagctggaaggccgtatttccggcagtattcactacgataacgtcgcgccctgcttcctgggcggcctgcagctgatgctggaagaaaacggcatcatcagtcaggacgtgccaggctttgaagagtggctgtgggtgatggcctatccgggcattaaagtctccactgccgaagcgcgcgccatcctgcccgcgcagtaccgccgtcaggattgtattgcgcacggtcgctatctggcgggatttatccacgcctgccatacgcagcagcctgcgctggcggcgaaattaatgaaagatgtcatcgctgaaccttatcgcaccaaactcctgcctggctttaacgatgcccgtcaggcggcggcagagatgggggcgctggcctgcgggatctccggatccgggccgacgatgtttgcggtgtgcgataacccggccaccgcgcagcgcgtggcagactggctcagccagcattatctgcaaaacaacgaaggttttgtccatatttgtcggctggatacggctggcgcacgcgtactgggataactaatgaaactctacaatcttaaagatcacaacgagcaggtcagttttgcccaggcaatcacgcaggggttaggtaaaaaccaggggctgtttttcccgcacgatctgccggaattcagcctgaccgacatcgacgccatgctggagatggatttcgtcacccgcagcagcaaaatcctcgccgcctttattggcgatgagatcccggaggagatcctcgaagcccgcgtgcgcgccgccttcgccttcccggcgccggtgagcctggtggaagaggatatcggctgtctggagctgttccacggcccgacgctggcctttaaagacttcggcggccgctttatggcgcagatgctgacgcacatcagcggcgacaagccggtgaccatcctgaccgccacctccggcgacaccggcgcggcagtggcccatgcgttttacggcctcgaaaacgtgcgcgtggtgatcctctacccgcagggcaaaatcagcccgttgcaggaaaaattgttctgcaccctgggcggcaatattgaaaccgtcgccattgacggagatttcgatgcctgtcaggcgctggtaaagcaggcctttgacgatgaagaactgaaaggggcgctggggcttaactccgccaactccattaacatcagccgtctgctggcgcagatctgctattacttcgaagccgtcgcccagttgccgcaggaagcccgtaaccagctggtgatctcggtgccaagcggtaactttggcgatctgaccgccgggctgctggcaaaatccctcggcctgccggtgaagcgttttatcgcggctactaacgccaatgacaccgtcccgcgctttttgcagggcggcgaatggtcgccgaaagcgacgcaggcaacgctgtccaacgccatggacgtgagccagccaaataactggccgcgtgtggaagagctgttccgccgtaaaatctggcgtcttaacgagctgggctatgcggcagtggatgacgaaaccaccaaatccaccatgcgcgagctgaaagagaagggctatctttctgaaccgcatgcggcgatagcctaccgcgcgctgcgcgatcagctgcatccgggggaatacggtctgttcctcggcacggcgcatccggcgaaattcaaagagagcgtggaagcgatcctcggcgaaccgctggaactgccgcaggagctggcggcgcgcgccgatttaccgctgctgtcccataccctgccggcggatttcgcggcgctgcgcaagctgatgatggcaagagcgtaatgtgatgacgttgcccggcggcgcaagcttgccgggcctacatatggttgggctggttatgcccggtggcgctgacgcttaccgggcctacgtatggctggcgcgttgttttgtaggcctggtaagcagagcgccaccgggcaacaagggcattaacggagggcgattactgctcccggcgtttaaagactaactcacctttccctgacatttcttcatcaaacgcatagccatccaccgcaaaatccttcagctgcgccggggtcttcaggcgattttgaataatgtagcggctcatcagcccacgcgcttttttggcgtagaagctgatcaccttgaacttaccgttcttctcatccaggaataccgacttgatgatctcgccgtcgagcagtttcggttttaccgcgcggaaatactcatccgaggcgaggttcacgatcacctgatcgccctgcgccgccagcgcctggttcagtttttgggtgatggtttcgccccagaattgatagagatcgctgccctgcgggttctcaagacgaatgcccatttccaggcgatagggctgcatcagatccagcggacgcagcacgccgtataacccggagagcatacgcagatgctgctgggcaaaatcgaaatcctcctcgctgaaggtttccgcctgtaagccggtatagacatcgcctttaaaggcgaggatcgcctggcgggcattgtccggcgtgaagtccggctgccagtcgtgaaagcgggtggcgttgagatcggcaagcttatcgctgatgcccatcagcgctttgatttgcggcgcggagagcttacgcgcaacgtcaatcagacgctgggaatgatccagtaactccggctgcgtatagcgggttgtcgccagcgggctttggtaatccagcgtttttgccggtgaaatcagaatcagcatatccagtccttgcgggaaattttgggtgactgtagcaaaaaaatcaccctgattgatcgattgttgcgattgccgccgttactcgcgcggcacctcgtcccaggcgccgggcgccagctggcgttcgatttccgggtagcgcttaggatcgaacaccggcctgatacccagcttacgctggcgcagataatcaccggcgataatggttaccaccggcgagagcagcagcagcgccatcaggttgatcagcgccattaacgccatcaccacatcggcgatctgccagaccaccggcagactcaccagcgagcctgccatcaccatcgtcagggtcgtggcgcgcagcagccagacgttccttttgttatgcagccgcaggaatacgaggttgttctcggcgtagagatagttcaccacaatggaagtcagggcgaaaagcagaatgacaaaagcgacaaaacccgctccccagttgccggtcagcgacaccagcgcgtgctgcatcagctgaatgccatcgctggcaggtcgggtggcatattcatccgccagcaggataatcatggcgctggccgtactgaccacaatggtgtcgatcaccacgccaatcatctgcacgataccctgcgccgccgggtgaggcggccaggagactgccgccgcggcgacgttgggcgttgagccaagcccggcctcgttggagagcattccgcgctgaaaaccgctggtgatcgcctggcttaaggtatagcccagcgtcccggcggcggcttcctcccagccaaaggcgcttttcacaatcagcatgatgatgtgcggaagctggtcggcatgccacagcgtaatcagcaggctggcgcccacccacagcaccgccatcaccggcaccacccattgcatcagccgcgccacgccgtgcatcccgcgcagaataaacaacaaactgagcagcgccagcacaaggcccgccatgccgcccggcatcgcaaaagcaaagtgaacggcaccggcaacggcgttcgcctgcatggtgttgaagatcagaccgtaggcgatcaacagcaaaacggaaaacagcacgcccagccagcgcattcccagccctctggcgagataccacgccggaccgccgcgaaactgctggttctggtcgcgctctttatacagctgggagagggagcattcggcaaaggcggtcgccatgccgatcagcgcagaaacccacatccagaacaccgcccccggtccgccagcggtgaccgccagcgccacgccggcaaggttgccgttgccaaaacgggcggcaaggctgacgcataacgcctgaaaggaggagagcccgccgggctgcggcctgacgctggtaataaggctgcgtgcgaagagacggatatagcgaaactggataaaaccgctgcgaaaggtgaaccagatccctgcacccaacagcaggtagatcatcaccgatccccacagtatttcattgatgaataaaaagaaatcaggcattcacattcctcttgttcatgccgttaggccacgcccgcttaccgcgcgcggcgctgtcgaaccgcgagtttatcatactctgcgcttgccaattgactgcggttgcgctgacagagtggcgtgatattatctgggcagaccggttacatccccctaacaagctgtttaaagagaaacactattatgacggataaattgacctcccttcgtcagttcaccaccgtggtggccgacactggagacatcgcggcaatgaagctgtatcagccgcaggatgccacaaccaacccttctctgatccttaacgcagcccagatccctgaataccgcaaactgattgacgacgctgtcacctgggcgaaaagccagagcagcgatcgcgcgcagcagattgttgatgcctcggacaaactggccgtcaatatcggtctggaaattctgaaactgatcccgggccgtatctccaccgaagtggatgcgcgtctgtcctacgataccgaagcgtctatcgccaaagctaagcgcctgatcaaactgtataacgatgcgggcatcagcaacgaccgtatcctgatcaaactggcttccacctggcagggtattcgtgccgctgaacagctggaaaaagaaggcatcaactgtaacctgacgctgctgttctccttcgcgcaggcccgtgcctgtgcagaagcgggcgtgttcctgatttccccgttcgtcggccgtattctcgactggtacaaagcgaataccgataagaaagagtacgctccggctgaagatccgggcgtggtttccgtaacggaaatctacgagtactacaaacagcacggctatgaaaccgtggtcatgggcgcaagcttccgtaacgttggcgaaatcgttgagctggcgggttgcgatcgtctgaccatcgccccggcgctgctgaaagagctggcggaaagcgaaggcaccatcgagcgtaaactctccttcagcggtgaagtgaaagcgcgtccggcacgtatcaccgaatccgagttcctgtggcagcacaaccaggatccgatggcggtagacaaactggcggatggtatccgtaagtttgcggtcgaccaggaaaaactggaaaaaatgatcggcgatctgctgtaatccccgaagcgtggccgggcctccggtcacgcttatccgcttcccccctgtctgtccttttccccgacgtgtattattccgtgatagtgaatgactaaaaacggaatgacgatggatactttacgcattggcttagtgtcaatttcagaccgcgcatcaagcggtgtctatgaagacaaagggttgcccgcgctggaaagctggctgacgcgcgccctcaaaaccccctttacgctggaaacccggctgatccccgatgagcaggccatcatcgagcagacgctgtgcgagctggtggatgagatgagctgtcacctggtgctgaccaccggcggcaccggcccggcgcgtcgtgacgtcacgccggacgccacgctggcggtcgccgatcgtgaaatgcctggctttggcgaacagatgcgccagatcagcctgcactatgtgcccacggcgatcctttcccgccaggtgggggtgatccgtaaacaggcgctgatccttaaccttcccggccagccgaaatccattcaggaaaccctggaaggcgtgaaagccgccgatggcagcccgctggtgcacggtatttttgccagtgtaccgtattgtgtacagctgctggatggtccctatgtggagacacatccggaagtggtagcagcatttcgtcctaaaagcgcaatacgcgaaataaacggccaaaaataagccttttgtgacataacctgagctgcctgtggcgtgctgaattatttacgatatagtaatttttactttacatgctgtatcgaaaataacgtcaattcacctctgcacaatggtcggttatgtcacattacacacgccctctgaatcgtcaggatgtcaaaacgctctccctcgctgcccttggcggggcgctggagttttatgacttcatcatcttcgtcttctttgccgccgttgtcggcgagctgtttttccctgcggatataccggaatggctgcgccaggtgcagaccttcggtattttcgccgccggttacctggcgcgtccgctgggcggcatcatcatggcgcactttggcgatctggtggggcgcaaaaagatgttcaccctgagcatcctgctgatggcgatcccgacgctggcgatgggtctgctgccgacctatgcctccattggtatcgccgcgccgctgttgctgctgctgatgcgcctgttgcagggggcggcgattggcggtgaagtgccgggggcctgggtttttgttgccgagcatgtgccgggcaaccgtatcggtatcgcctgcggcacgctgaccgccgggctgaccgtggggatcctgctgggctcggtggtggcgacgctggttaacaccagcctgacgccacaggcggtgcacgattacggctggcgtattccgttcctgctggggggcgtgtttggtctgattgccatgtatctgcgccgctggttgcaggagacgcccattttcctcgagatgcagcagcgtaaagcgctggcccaggagttgccggtgaaggccgtggtggtcaggcaccggaaagcggtggtggtatccatgctgctgacctggctgctgtcggcggggatcgtggtggtgatcctgatgtcccccgtctggctgcaaaaacagtatggtcttgcgcctgcgctcaccttacaggccaacagtatcgccaccattatgctgtgcatcggctgtctgctggcggggctggcggcggatcgctttggggcgagcaaaacctttattaccggcagcctgctgctggcctgctcaagctggctgttttaccacctggcgggggcgcatccgcaatatctcttcgcgctctatggcctggtggggctgtgcgtcggcgtagtgggggcggtgccttatgtgatggtgcgggctttcccggcggaagtgcgttttaccggcatctccttctcctataacgtctcttacgccatttttggcggcctgacgccgattgccgtcaccatgctgatgggcgtctcgccaatggcgcccgcgtggtacgtgctggcgctgtcgctggtggggttagggctgggcgtctggctgcgccaggatctgtatcatgacgatacggtcgcggagcagccgcttcagcagatgtaaaaaaaatgcagagcctggctctgcatttttgttttacgctcagcgcaggatggtgacgtctgagaacgtgaagcgttttttcttcccgtcttcctgatagccgatgcggataaatacccgcagatcttctatccacgcgtaatcgctgctcatcgctttgccatcgccgcgatcgtcggtgcagctcagttccagataacgtccgctgaaacgcttactgagcgcggaggctgattgccactcctcttctgcccggcacagctggcttttcgttttctctttcccggcgcttttgccgtcggcaagcagggtctgccagcggtattcaccgcccggctgcggcggcaggctgaagctgctgtccagcgtctgcccgaccagcggcgcaggattcatcgaatcccattcccggatgttgacgatattaaacagccgctgatactgcgaataaaaggtcacattgcccagcgtcagcgtatccagcgccagggtggagccatccggcagcacgtcgatgcgggtgacggaggtttcattgacgtcatcggcccagtgctgggtgtaggtcaggcgggtgaaggcgggatgctgatcggggcgggtcatcgcctggctgataccctcagcggcctgtttgcccagcggataacgctggatggggccaggttcgttctgcgggaaatccggcggcgtcagttggttttccgcaggggttttctcccgcgccaccagcgggccgctgccggtaaactcatgcagatcttttacgccgcacagggttttcgccacttttgccagcggcggggcgagcggggtgaatttcgccgcgatgggcgtctggctgtcggtaacaaactgcttatccagcgcaaagtggttaagcgccatgccctcgccggtttcgcagttaagcatcatctcgtcaattttcattgagtaaggcgcggcatacttttcgtcacggtaaatgcgcgcgtaatcggtggcgagccgcactttcagcatccgctcttcacgctgactgttgttcacatccacatacaggcgatcagcctggtcgtcggcggaggatagccctgcccagcgcggttccggcacatttttctggcacacgtccagctcggttttggtggcgaacaggctgtcagcatcaggttcaaagggagtgcccggcgtataacgggaaatggaattcatgctatagacgcgcagagaggggcgggattttgcctgcacgtccataaacagcaacgttttttgctgcgtgcggcagtcgatattcatccacatatcattggcatcgccgctcgccagcgagacgcgaaaaatagcgttaatggtatcgcccatgcgcacggtgctgccgggtagccattcaacattggtgacggcgggagcgggtggcatggggatcgcccgcgccggtgctgtcgctatcagccccagagagagtaaccccaacggaaggggagataaccgcatcatcggcagtccttgttaaaaagaaagagctgatgaaaataccgcatttttgcgcggcaggacaatgacgcggcgcgagggcaaaaaaaatgcagagccaggctctgcattttaataagcagggagattagcgcttttcaccaattggcagcacggtgcggccaaattgttcgttcaggacttcacccatcgccaggtaaatggcgcttgcgccgcagaccaggccaatccagccagcaatatgcacaatgctttcgttgtccgccaggtgaccggcgcacagcagggcaaacagcacggtcaggctcaggaatacgaactgcagcatgcgcgggcctttcagcgtaccgaagaacataaacagggtgaacacgccccagatgcccagatacacgccgaggaaatggccgtcagccgcagccgccagacccattttcggcagcagcagaatggcgaccagcgtcagccagaaagagccgtaagaggtaaaggcggttaaaccaaaggtattgccttttttaaattccagcagacctgcaaaaatctgcgcgataccgccgtagaaaatacccatcgccaggatcacgccatccagcgggaacataccaatattgtgcaggttgagcagaatagtggtcatgccgaagcccattaagcccagcggtgccggattagccaacttagtgtcgcccataagtcctcaaggaaaaaatcatcattaaaatggtgaaagtaaaagcccacgccagggatagaggaggcggggcgcggcatcataatgagcggcggtcacggtgtctatgatctgaacagggtgaaattaaaaaattttttagccgccccccttgatgccttcctttacgaccccatcttgtagtcaaccgaagtgagtggatctgaaaaaaacactcagggggcagttgaaagccattcatttgcccttattacagatccacaaccacatgatgacgaatttttagtggagacgtttagatgggtaaaattattggtatcgacctgggtacaaccaactcttgtgtagcgattatggacggcaccactgcacgtgtgctggagaacgccgagggcgatcgcaccacgccttctatcattgcttatactcaggacggtgaaactctcgttggtcagccggctaaacgtcaggccgtgacaaacccgcaaaataccctttttgcgattaaacgcctgatcggtcgccgcttccaggacgaagaagttcagcgtgacgtgtccatcatgccgtacaaaatcattgctgccgataacggcgatgcctggcttgatgtgaaaggcaccaaaaccgcaccgccgcagatctctgctgaagtgctgaaaaaaatgaagaaaacggcggaagattatctgggcgaaccagtaactgaagcggttatcactgttccggcttactttaacgatgcgcagcgtcaggcgaccaaagacgccggccgtatcgcaggcctggaagtaaaacgtatcatcaacgaaccgaccgctgcggcgctggcttacggcctcgacaaagaagtgggcaaccgtactatcgcggtttatgacctgggcggcggtactttcgatatctccattatcgaaatcgacgaagttgacggcgaaaaaaccttcgaagttctggcaaccaacggtgatactcacctcggtggtgaagactttgacagccgtatgatcaactacctcgttgaagaatttaagaaagaccagggcatcgacctgcgcaatgacccgctggctatgcagcgtctgaaagaagcggcagaaaaagcgaaaatcgagctgtcttccgcacagcagaccgacgtgaatctgccgtacatcaccgcagacgccaccggtccgaaacacatgaacatcaaagtgactcgcgcgaaactggaaagcctggtcgaagacctggtaaaccgttccatcgagccgctgaaagtggcgctgcaggacgctggcctgtctgtttctgacatcaacgacgttattctggtcggtggtcagacgcgtatgccaatggttcagaagaaagtggctgagttcttcggcaaagagccgcgtaaagacgttaacccggacgaagcagtggcaatcggtgccgcggttcagggcggcgtgctgaccggtgaagtgaaagacgttctgctgctggacgttaccccgctgtcgctgggtatcgaaaccatgggcggcgtgatgactccgctgatcagcaagaacaccactatcccgaccaagcacagccaggtgttctcgacggcggaagataaccagtctgcggtaactatccacgtgattcagggtgagcgtaaacgcgcttctgataacaaatcactgggtcagttcaacctcgacggtatcaacccggcgccgcgcggtatgccgcagatcgaagtgaccttcgacatcgatgccgacggtatcctgcacgtttccgcgaaagacaaaaacagcggcaaagagcagaaaatcaccatcaaggcgtcttctggtctgaacgaagaagaaatccagaaaatggtgcgcgatgctgaagcgaacgcggaatctgaccgtaagttcgaagagctggtacagacccgcaaccagggcgaccatctgctgcacagcacccgtaagcaggttgaagaagcaggcgatcagctgccggctgacgacaaaaccgctatcgagtctgcgctgagcgcgctggaaacttctctgaaaggcgaagataaagccgacatcgaagcgaaaatgcaggcgctggcccaggcttctcagaagctgatggaaatcgctcagcagcagcatgcacagcagcaggcgggcggtgctgacgcttctgcgaaccatggcaaagatgacgacgttgtcgacgctgagttcgaagaagttaaagacaaaaaataatcgccctttgaacgggtaaatactggcacgggcgaagaggtttcctctccgcccgtgcacgcatgtgaggggcagaaaaaaaagatggcaaagcaagattattacgagattttaggcgtttccaaatcagcggaagagcgtgaaatcaaaaaggcgtacaaacgcctggccatgaaatttcacccggaccgcaaccagggcgataaagaggccgaagccaaattcaaagaaattaaagaagcctacgaagtcctcactgatgcccagaaacgtgccgcttacgaccagtacggccatgctgcgtttgaacagggcggcatgggtggcggcggtggttttggcggcggcggagccgacttcagcgatattttcggcgacgtgtttggcgatattttcggtggtggtcgcgggcgtcaacgggcgtcgcgtggggctgacttacgttacaacatggagctgacgctcgaagaagccgtgcgtggcgttaccaaagagatccgcattccgacgctggaagagtgtgacgtttgccacggcagcggcgcgaaagtggggacgcaaccgcagacctgtccgacttgtcatggttccggtcaggtacaaatgcgccagggcttctttgccgtgcagcaggcgtgtccgcactgtcagggccgcggttcgatcattaaagatccgtgcaacaaatgtcacggtcatggccgcgtagagaagagcaaaaccctgtcggttaaaatcccggcgggtgttgataccggcgaccgtatccgtttgtccggcgaaggtgaagcaggggagcacggcgcaccggcaggggatctgtacgttcaggtgcaggtgaaacagcacccgatcttcgaacgtgaaggcaataacctgtactgcgaagtgccgatcaactttgcgatggcagcgcttggcggcgaaatcgaagtgccgacgctggatggccgcgtgaagctgaaagtgcctcatgaaacgcagaccggtaaactgttccgtatgcgcggcaagggcgtgaaatccgtgcgcggcggcgcgcagggcgacctgttatgccgcgtggtggtggaaaccccggtgggcctgaacgagaagcagaaacagctgctgaaagatctgcaggacagctttggtgggccgacgggcgaacacaacagcccgcgctccaaaagcttcttcgacggcgtgaaaaagttctttgacgatctgacccgttaatccgaagacggctgtctttgcacaaaaccgataccttttaccgggtatcggtttttttattgcttcaatactcgggaaaactgagttattagtcagtgataatctgcttttatcgaaccttcattctctttaagatggccccacatgtgcttcgttgtcggagagaaaagaataatgaaggtcttacatcgttttattaacagcgacgcctctggtggcgttacgctgatcgttgctgccctgctggcgatgattatggcgaacctcgacgcgaccagcggcctgtatcgtgattttctcagcatcccggtggagttaaccgttggatcccttgagatccataaagatatgctgctgtggatcaatgacgccctgatggccgtcttcttcctggccattggcctggaagtgaaaagcgaactggtgcagggatcgctggcgacgcgccagcaggccgcttttccggtcatcgccgctttaggcggtatggtccttccagcgcttatctacctgctgtttaacgttcacgatcccattgcccgtcacggctgggcgatccctaccgccaccgatattgcctttgccctgggcgtgctggcgttactggggaaccgcattccggtggcgctgaagattttcctgatggcgctggcgattatcgatgacctgggcgcgatcctgatcatcgcactgttctacaccagccagctgtcgatgctgtcgctgggcgtggcggccgcggcgatagtggtgctggcgctgctcaatgccctgaacgtgcggcggacggggatttatattctcgtgggactggtgctgtggacggcggtgctgaagtccggcgtgcacgcgactatcgccggggtgatcatcggcttctttatcccgctgaaggaaaaagacggcgtctcaccggcaaaaaatctggagcacgtgctgagcccctgggtgagctggctgatcctgccgctgtttgcctttgccaatgcgggcgtttcgcttcaggggatcacgccgaccagcctggcctccatgctgccgctgggtattattgccggtctgtttatcggtaagccgctcggtattaccctctttacctggcttgcgctgcgcctgaagctggcgaaactgccgcacggcacggcgttcaaccagattatggccgtgggcgtgctgtgcgggattggcttcaccatgtctatctttatcaccacgctggcctttgccgagctggagccggagctggtgggtctggcgaagctggggatcctgctcgggtcgttggtctccgccgtggtgggctacgtcctgctgcgctcgcggttaaagcccgtataactgacaaatgcaggctgccctgagcagcctgcgctgtcacgggcaggagaaggttatggcgcatattaactacaaccatctgtactacttctggcaggtctatcagcagggttcggtggtcggggcggccgaggtgctgcacctgacaccgcagaccatcaccggccagatcaaggcgctggaagatcgtttacagggcaagctgtttaagcgtaaaggccgtggccttgaacccagcgagctgggggaactggttttccgctacgccgataagatgttcaccctcagccaggaaatgcttgatatcgttaactaccgtaaagagtctaacctgctgtttgatgtgggcgtggcggatgcgctgtcgaaacggctggtcagcggcgtactggacgcggcggtggtggaagatgagcaaattcatctgcgctgttttgaatccacccatgaaatgctgctggagcagctcagccagcacaagctggatatgatcatctcggactgcccgatcgattccacgcaggaagcggggctgttctcggtgaagattggcgagtgcggcgtcagcttctggtgtcttaacccgccgcctgccaggccttttccaggctgccttgaagaacgccggttattaattcccggccgtcgctcgatgctcgggcgtaagctgctcaactggtttagttctcaggggctggaggtggaaatcctgggggagtttgatgatgcggcgctgatgaaagcctttggcgcggcgcataacgctatttttgtcgccccgacgctttacgcccaggacttctatgccgacgagcgcatgattgagatagggcgggtggagaacatcatggaggagtatcacgcgatttttgccgagcgcatgatccagcatcctgccgtgcagcgtatctgtaaccgggactactcgacgctctttactttaccgcagacgtaaaaaaacccgcctgagcgggtttcttcaacaaagtacaacaagcgggcgattaagccagtttgttgatctgcgcggtcaggttagccttatgacgcgctgctttgtttttgtggatcagacctttagcggcctgacgatccacgatcggttgcatttcgttaaatgctttctgcgcagctgctttgtcgccagcttcaatcgctgcgtatactttcttgatgaaagtacgcatcatagagcgacggcttgcgttgtgcttgcgtgccttttcagactgaacggcgcgcttcttagctgatttgatattagccaaggtccaactcccaaatatgatctatgtggacaattcaaaggccgaggaatatgccctcttagccttcttttgtcaatggatttgtgcaaataagcgccgctgcgtagcgacactcgttacgtgtgatggcgcaggattctaccagcaagccgcgcgtagatacagcttttccgccataaaaatcacaggcaaggggcagttttttcgcaggcctgacataagcacaatgaaatcaacacagctttctgtttacgaaggccaatcgccggttaaccttgaacgctgtacaaggtatactctgccgatttccccgtttttgagccagacatgaagctgatacgcggcatacataatctcagccaggccccgcgcgggtgtgtgctgactattggtaatttcgacggcgtgcatcgtggtcatcaggccctgatcgaggggctgcgtgaagaaggccgcgcacgtggtttaccggttgtggtgatgatttttgagccgcagccgctggagctgttcgcgggcgataaagcgcccgcccgcctgacgcgcctgcgtgacaagctgcgttatctggccgaatgcggcgtggattacgtgctgtgcgtgcgcttcgacaggcgctttgccgcgctgacggcgcaaaacttcgtcagtgatttgctggtcgaccgcctcggcgtgcagttcctcgccgtgggggatgatttccgctatggcgctggtcgtcagggcgatttcttgttattacagaaggccgggctggagtatggttttgacgtcaccagcacgcaaaccttctgtcaggatggtgtacgcgtcagcagcacggcggtgcgtcaggcgctggcgaacgatgacatcgcgctggcggaaagcctgttaggccatccttttacaatttccgggcgcgtggtgcatggcgatgcgctgggccgcaccatcggcttcccgacggcgaatatcccgctgcgccgccaggtctccccggttaaaggggtatatgccgttgaagtaacggggttgggcgataaacccctgccgggcgtggccaatatcggtacgcgccccacggtggcgggcgtgcgccaacaactggaagtgcatctgttagacgttgtaatggacctctacggacgccatatagatgtcatactgcggaaaaaaattcgcagtgagcagcgatttgcctcgctggatgaactcaaagcgcaaattgcgcgagatgaattaaccgcccgcgagtttttagggctacaaaacccggcgtaacgccaacatacgttttaaatacggaactgagaatctgatgagtgactataaatctaccctgaatttgccggaaacagggttcccgatgcgtggcgatctcgccaaacgcgagccgggaatgctggcgcgctggaccgatgatgatctgtacggcatcatccgtgcggcgaaaaaaggcaaaaaaaccttcattctgcatgatggccctccctatgcgaatggcagcattcatattggtcactcggttaacaagattctgaaagacattatcgtgaagtccaaaggactcgcgggctatgattcgccttatgttccgggctgggactgccacggtctgccgatcgagctgaaagtggagcaggaattcggtaagccgggcgagaagttcaccgccgcagaattccgcgccaagtgccgcgaatacgccgcaagccaggttaacggtcagcgtgaagactttatccgtctgggcgtgctgggcgactggtcgcacccgtacctgaccatggacttcaaaaccgaagccaacatcatccgcgcgctgggtaaaatcatcggtaacggccacctgttaaaaggcgcaaaaccggtacactggtgcgttgactgccgctctgcgctggcagaagcggaagtggagtattacgacaaaacttctccgtccattgacgtggccttccaggctgtcgatcaggacgcggtaaaagccaaattcggcctgccaggcgtagctggcccgatctcgctggtgatctggaccaccaccccgtggacgctgcctgctaaccgcgcgatctccctgtcgccggagtttgattacgcgctggtgcagattgacggccaggcgctgatcctcgccaaagatctggtcgagagcgtgatgaaacgcatcggcgtggccgattacagcgtactgggcaccgtgaacggcgcagaacttgagcagctgcgttttgcccatccgtttatgggctttgacgtgccggctattcttggcgatcacgtcaccctcgatgcgggtaccggcgcggtacataccgctggcggccacggtcctgacgactacaccatcagccagaaatacggtctggaaatcgccaacccggttggcccggacggcacctatctggcgggcacttacccgacgctggacggcctgaacgttttcaaagccaacgacaccatcgttgagctgctgcgtgaaaaaggcgcgctgctgcacgtcgaaaaaatgcagcacagctatccgtgctgctggcgtcataaaacgccgatcatcttccgtgccaccccgcagtggtttatcagcatggatcaaaaaggcctgcgcacgcagtcgctgtctgagatcaaaggcgtgcagtggatcccggactggggccaggcgcgtatcgaatccatggtcgcaaaccgtcctgactggtgtatctcccgccagcgtacctggggcgtgccgatgtcgctgttcgtgcataaagataccgaagagctgcacccgcgcaccctggaactgatggaagaagtggcgaaacgtgttgaagttgacggcatccaggcctggtgggatctcgatgcgaaagagatcatgggcgatgacgctgacaactacgtgaaagtgccggatacgctggacgtgtggttcgattccggatccacgcactcctccgttgtggatgtgcgtccggagtttgccggtcacgcggcggatatgtatctggaaggctccgaccagcatcgcggctggttcatgtcctctctgatgatctccaccgccatgaaaggcaaagcgccgtatcgccaggtactgacccacggtttcaccgttgatggtcagggccgtaagatgtccaaatctatcggcaatactgtcagcccgcaggatgtgatgaacaaactcggcgcggatattctgcgtctgtgggtggcgtctaccgattacaccggcgaaatggcggtgtctgacgagatcctcaaacgcgctgccgacagctatcgtcgtatccgtaacaccgcgcgcttcctgctggcgaacctgaacgggttcaatccggccaccgacatggtgaaaccggaagagatggtggtgctggatcgctgggcggtaggctgcgcgcaggcggcgcaggacgatattgttaaagcgtatgagtcttacgatttccacgaagtggtacagcgcctgatgcgcttctgctccgttgaaatgggctcgttctacctcgacatcatcaaagatcgccagtacaccgcgaaagcggacagtgtggcccgtcgcagctgccagaccgcgctgtaccacattgccgaagcgctggtgcgctggatggcgccgatcatgtccttcaccgccgatgaaatctggggctacctgccgggcgatcgcgaaaaatacgtcttcaccggcgaatggtaccagggcctgtttggtctggcggaaaccgaagccatgaacgacgcgttctggagcgagctgctgaaagtgcgcggcgaagtgaacaaggtgatcgagcaggcgcgtgctgataaaaaagtcggcggttcgctggaagcggcagtcaccctgtacgcagaacctgaactggcggctaaactgacggcgctgggcgatgaattacgatttgtcctgttgacctccggggccgcggttgccgattatgcaaccgcgtccgacgacgcccaacagagcgaactgctcaagggactgaaagtgtcgctcagcaaagccgaaggcgaaaaatgcccgcgttgctggcattacacgaccgacgtcggcaaggtggcggaacacgcagatatctgcggacgctgtgtcagcaacatcgccggtgacggcgaaaaacgtaagttcgcctgatgagtaaaccgatcttttcaacagggctgcgctggttgtggctggtagtggtcgtgctgattatcgatttgggcagtaaattcctgatcctccagaactttgctctgggggatacggtatcgctgttcccgtcgcttaatctgcattatgcgcgtaactatggcgcggcgttcagtttcctcgccgacagcggcggctggcagcgctggttctttgccggtatcgcccttggcatttgcgtgatcctcatggtcatgatgtatcgcgcaaaggcgtcacagaagctgaacaacatcgcctatgcgctgatcattggcggcgcgctgggtaatctgttcgaccgtttgtggcacggttttgtggtcgacatgatcgatttctacgtcggcaactggcatttcgcgacctttaatctggccgatacggccatttgcattggcgcggcgctgatcgtgctggaaggatttttgccttcccgcgcgaaaaaactcgcataaccaatcgccgggcggcgctacgcttgcaccggcctacgatccctgtaggcccggtaagcgaagcgccaccgggcaacaaaatttaaatagagcaacctgcatgtctgaatcgatacagagcaacagcgcagtactggtgcacttcaccttaaagcttgaagatggctccactgcggaatccacccgtaacaacggcaaacccgcgctgtttcgtctgggcgacgggtcgctctccgaagggctggaacagcatctgctggggctgaaagcgggcgataaaaaagccttctcgctggagccggatgcggctttcggggtcgtcagccccgatctgatccagtatttctcccgtcgtgagtttatggacgcgggcgagccggaaatcggcgcaatcatgttatttaccgcaatggatggcagcgaaatgcccggcgtgatccgcgaaattaacggcgaatccattaccgttgatttcaaccatccgctggcgaaccagaccgtccattttgatattgaagtgctggaagtcgatccggtactggaggcataacatgcagatcctgttggctaacccgcgcggtttctgcgctggcgtagaccgcgctatcagcattgttgaaaacgcgctggcgatttacggcgcgccgatttatgtgcgtcatgaagtggtgcataaccgttacgtggtggacagcctgcgcgagcgcggggcgatttttatcgagcagatcagcgaagtgccggacggcgcgatcctgattttctcggcgcacggcgtttcgcaggcggtacgtaacgaagcgaaaagccgcgatctgaccgtctttgacgccacctgcccgctggtcactaaagtgcatatggaagtggcgcgcgccagccgccgcggcgaagagtccattctgattggtcacgcgggccatccggaagtggaaggcaccatgggccagtacagcaacccgaaaggcggcatgtacctggtggaatccccggacgacgtcttcacgctgaacgtcaaagacgaaagcaaactgtcgtttatgacccagaccacgctctcggtggacgatacctctgaggtgatcgacgccctgcgcgtgcgtttcccgaaaatcgtcgggccgcgcaaagacgatatctgttacgccaccactaaccggcaggaagcggtgcgcgccctggcggagcaggcggacgtggtgctggtggtggggtcgaaaaactcctccaactccaaccgtctggcagagctggcacagcgcatgggtaaagcggcgtacctcattgacgatgccgacgacattcaggaggcctgggtcgccagcgccgcctgtgtgggcgtcaccgcaggcgcttccgcgccggatattctggtgcagaacgtcatcaaacgcttacaggcgctgggcggcggcgaagccattccgctggaaggccgtgaagagaatatcgtttttgaagtgccgaaagagctgcgggtcgacgtgaaagaagttcactaacgcagaggttacgcataaaacgccaatgccagccggtgaaaacccgctggcatttttatttaacgcccctgtgatccctgcatcaaaatgcgcagccttcacattaagttaatcgattaacctgttactgttattgggttgttctcctcgggccggagataaccatgaaaccttctttagctctgccgccgcaggtggcatgggccagcggcgcattagccaatggctcgcgcatccgtaaatcgacctgccttcaccagctggagggcgtattcgccgatacgctcgccttccatcaatgcgatccacaccagtgcgtctatgacgtggagatgtttgactccccgaccgccgacggggcgctttacgttggcgtcactcacctctaccccggcaaagtaggcgatgaatacttcatgacgcggggtcattttcaccagcgccgcgagcagggcgaagtctatttcgggctgcgcggcagcggcttactactgctgcaaaatgaacagggggaggcgcggctggagaaggtcatgcctggatccgtacacatcattcccggttttaccgcccatcgtctgatcaataccggcaacgaaaccctctcggcgctggcggtctggccgtgcagcgccggacacgattacgccgcgctcagcagcggttttgcgctgcgcatcaccgaagaaagcgaggtgcgccatggctgagcaaccttttgattgcggtctggatatgactgtccatcgtcagccgctggggttcagctatggcggagaggtcatcggcccgctggcggagatccgcacgctcgatcagatccgcgcttcgctgcgcgatccatactgtcgcggcccgaatgaggtgtacgccattgcgatggatgtggcgcgcattcaggatcgcgacgagctgaaaaaacgcatgctgctgttcggcgtggtaacctatgccgccgggcaactgggcgacgagccggtacgcagccaggggcacgtacaccgcatcagccagcacagcggctggtcgccgccggagctgtacgagatctggcagggcagggcgattatctatatgcaggagtatgtggctgacgatccggggcgctgcttcgcggtgatcgccggtcccggcgaaaaagtgctggtgccgccaggctggggacacgccaccatctccgccagcccggatgaacccttaaccttcggcgcatggtgcgatcgggaatacggcttcgagtacgacgccgtgcgggcgcacaaagggctggcgtggtatccgctgttacaggaaaaacagattatctggcagcataatccgcactacgcgccggggcgcttacaggcgatcaccccccgacgctacagcgaattcggcattactgccgcgccgctctatcagcagtttattgacgatccggcgcgcttccagtttatctcccgccccgataaagccgcagatcggtggctggattttcatccttgataaaaccccggccgggtgagctggcgtcacccggcaaaccttatcccgcgaataccccgctcacgacgcctgcggcggcaagcgccagcaacagcagcatcgctttgaccggcgacacgccgcgtttcgccatcaggtaccaggtgccgagcaccacgacgagcggcaaaagttgcgggaaaataccgtccagcatctgctgcacatgaatattcaccccgtccttagtgataaactcaagcccggtgccgagcttaacgtagcttgccgccacgccgcccatcacgaagacacccagcagcgacagcgcttcccgcaggcgggtagatttactgctcaccagcatctccaccgagccggatcccattttgtagcctttcagaaacaggaaccatgaaccgggaatgatgatcgccagccaggcgacggcataaaacagcggcccgagggcgctgccgcccgccgccagcgccatgccgatactgagcaggatcgggatcagcatcccggggatcatcgaatcgccaatgcccgccaccggccccatcagacccaccttcagcgtgttgatcatgtcaccgtcaatgggttcgccgttagcttttttctcctccagccccagcaccatgccgttcacaatggctcctagctgcggctcggtgttataaaaagacgcatgacggcgcagcatttcctggcgttcggcggcatccggataaagctttttcgccaccggcagcatactcaggcagaagccgaaggattccagacgctcaaaactcatggatgacagattgtgcatcatccacgcccgccagcagcggcgcagatcggttcgggtaagggtgcgattgtccatcagaattcatcctcatcatcgaccggcgcggtcgccacaggctgcgcgggttccggtttgtagttgtagtggatcagcgccagcagcgcgccgacgatcaccagcgcgaccatattgagttttaaaaagacgatgcagacgaagccgaccagaaagtagatcagcatgctgtagtttttgatgatctgcttaagcagaatggcgatccccaccgcaggcagaatgccgcccagcacgttcatgctggaaagcaccactttcggcaggctgtccataaaggcgctgatgtactgcgcaccgaagtagacggcaataaaagtcggcacgaagcgtaaaacaaagttggtcgcctgcggccagatggcgctgttaagccacagaccacgctcgtcgccgcgctccagcgccacatccgcccggtgattccagaacgaattcagcaccatcatggcgttaaacaaaatggttccggcgatgccgatggtcgccgccagcgccaccgccacttccggcccctgcccggaaagaatgccgagcgcaatcgccggataagccacaaaattcagatcggcgggcatcgagccgcccggcgtcaccatggcgatatataccgcctgcaccgccacgccgatgataatcccggttttcatgtcccccaggatcagccccaccagcatcccggataccagcggccgggtgatcagataccagccgccggttaagcccagcagccaggggctgctcagcgcgcccaggtagcacagcaggccaatcagtatcgcgtcgataaacatacaacccccttatttcagtttctgccgcgcgtcctgccagcggtagctgttggcatccggcaccagacgaaactcaatcagatgcccgtgcgcggccagccagtcaaaggcggcaatctcttcggcgttaaccgactggtttgggccgatggtagtggtatccgcgcgggcgctcatcggcccgacgttgattttgccgttggcgttttgcaggttgatcccggcctgcgccaggcgttgcagcgtgaccggcgatttaccgatcacgaaatactgcttttcactggcgatgaccttcggcagtttttcaatcgccgtggcggtatcgaacagccacaccttgatgtcctgaaccgcgcctttcatcaccgacgaaagcagcggatcggccgcgacggcatcatcaatggcgataatgccatcgcagggcagctctttggcccagcgcgtgacgagctgcccgtgaatgacgcgatcgtcaatacgcacaaaagaaagactcatagcaggctcctttaaaaatcatcggatggttcatcagtaacagggacggctttgacgagcgtcggcaacgtcagcgccagcaatcgatccgccgcacggtggacatcggtaaaatcgccgatctcatcgctttgcagcagcatgggaaaattcaccccggccagtaccgccaccggcggcgtggtctgcggggagaaggcatactggcaggcgacattccacggcgtgccgctttgcagatcgcacagcaccagcacgccgtcggcgttctcacttgcgcgggccagctcgcgggcgaaatcacgcttaaagccgtcaatacccgcctgctcgctgagcgtaacgctggaaacctgaggcagctcgccgtacaccatacggctgctgataagcagcgcctccgccagcggaccgtgcgtggcaataatcacgttgatcatctttacccccttacccaggctttgagcgtggcgcattgttgcccgtcgccgcagggcgaaatgcggtactcgcccacggcggcgggaataatgaaggtttcggcataatgcaccacgaagggcgcaaaggccccgtccgggctgtcaaccagcgcttctgtgccctccaccagattgagcacgttaacgccgccctctgtgtgatgcatgaccggcgcggtaaaccagtggcggcgggtttcgataaattcccgttcatgcagcccggtacgctcttcgcgccagctttcgccttcggcgaccgtctcaatgcggtttaccagattgtcgtgcacccacgcggtatcgcgctgccagtcaatcacctgtgcgccgtgatggagatgcaccgggcgcggcaggccgtccatccccacgcgatcccagtcccatagcttgaaggtgaaaatgtagggcgtggcgctgacctccagtaccatggttcccgcgccggagcagtgcaccgtgcccgccgggatcaggaagtgatcgtgcttgcgcgccgggatctgattcacaaagcggccgtcgtcaaagcgcttttctccccggctggcggcgtgcagatcctccagcatcgcctgcggatcgatgccggttttggtgccgagatacaccaccgcctccggcgtcgcgtccagaatgtagtaactctcatcctgggtgtaatgcataccaaactgctgttgaatgtattccgtcagcggatgcacctgcaggctcagattctggccgccgatggtgtcgagaaaatcaaaacggatcgggaactccgcgccaaaacgggcgtggactttctcacctaacagcgcgcggggttgcagcagcaccagatcctgagcggggatctcgatccgcacatcgccaaaccgtagcaacaggctgttttcctcgggcacgcagtcaaaacaccaggcatagtttggttttgtgggatcgagatcgaattgctgtttcatccactggccgccccacacgccagggtcgaaaaagggcatcacgcgaaacggttgttgcacggtttgcgccagcccggcgcgaagcgcctcgccgctgatgagcgcaggcgtatcgccagcggtagtgtcgagcagataatcggcacgtttgagcagcggcgttttgtggcggtcaaacacccgccattcgataaaaaaggcgcgcttgtagcggcgcagaatatcctcatcggcgttatccacgccccagttactcagttcgccgctgcgcatccgctgctgaatttcccagcgcggcagatcggcgtacaccagcacatcgcccggatgcaccagcgccgcgcccgggccatagatcaccgtcagcccgtcgctggcctcgctcacctgctggcgcagcgcccggagtttgtcctcatcaaagaactccacaagctggtggcaggagagcacgccgaacacccggtcgtccgtaagatggcgcgccagcagatgatgcaggtcctgcgcatcccggcgggcgtgctcaacgttaatcacccgcgtggccccgagcgcgggcagcatcctttcttccagctcgcgcaatcgcacgccgggatagcaatcgatcaccagcacgctgcccggctgagcgcgtgcgttcagcacttcggcgattgaattccagccggaccacgcctggtggtcatagccgtgcacgtacacttccggggacttctcataggttgagccagtcattgcagatctcctgtaacaattgccagcgtcaggtaatcgccgggggcgattagcgcgtcatcgcgcagtgccgtgcgccgggcttcgtttaacgacaactgataaatccggctgcccggtgggacgataagcggacagcgttccggctgcggcatggggttaaacagccgcaccaggatttcaccgtcgcgcgtaccggggcggcacatgctgaggaacaagcgcggattgccgcaggcgattagctgtgactctggcggcaggccgtacggggcaatgggcagcgtgaagcgctccaggcgctcctcaaaggtattaagtttttgcacctgataggtgaggtaatgctcgcggtaatccctgcaggcgctgaaaatcgccgccgcatcctgcgggccatccagcagcagcgcatagtcgaatgccatttcctgcaacatctgcgcgtccggcgtttcgacgactttgttattgatgccggacgcccggccaggccgccacagggtatcgtctttaccgagcaggccaacgctgcggaacagcgtcagcgccagggtatcgctccccggcagcacctcgtactctttgatgcctttggttatcacgccgaaacagtgctgttcatcctgcagataaaccacgttttccagcgtgtagatgggcatcggtttttccacaaagcccagctcgcgccactgtgcaacgtaagggttcaccgtctcgcggcgaataatactgaagccctgatcggcaaaggaatagttgggctgttccaccggcgttttcaggtgtacccgcaggcggtgctcggtggcggcgttgatcagctgatgatgcacgcgcacaaaaccttcgccgtcgcgcagctcaagcgtagtggcgatggccattttctggcgggcgatccctgtctgccgttccgccatattcgcgggcagcatgagggaggatcgcagcgtcaggcgcgacacctgcgcgctgctttcacaggtcacaacgtggaattcccggcaggtgagcggctgctcgtccgccagcggcgcgaagtcgaattcatcgccgtcatcaccgcaatcgacaaaggttaagaaatcttccacgcgctggccggtctgtttgttctccagcgtcagcacgccggaggcgaggctgatacggtagcgggcgttttcaattaccggcaggtcgcgccgcaccagacgggcacaggattgctgctcctccacccgtaacgtctgatagccgaggcccggcagcgacggcgggcgaaagaggatctcactgcggtagtagtcggccaccggttcgagtttttcgcccgcggcggtgacgatcaccacctggccgccggagagtttttgctgttgcagcagggtgctctccaccgccacgccgttctgcgtcagggtaaaatcgggttgttgggtgaagatcaccgcgcgggcaagcggggacagcggactgatgtcgcagttaaacaccaccagcagacgctcatccgcctgctggcgggcgatctgatagctgattttcttcttcagcacgttaagcaggctcagcgccgagcgctcgacgctgatcaaccggtttttaatgttctgattcaccgcatcggcgttggtggcctcaatgccattgtgcgcgtgtgcggcgaacagcgttttccacatgctgtcgataaccggctgcgggtacgtcacgccgaggtgcgaggcaaccgccatcagcggctccagctgatcgagcagaagatgctccgtctgccaggtctggcgtttgatgtcgtagcgcgtggagtggcaggtacggtggatacgcgatttctgacaggccaccagttcaccgtcaataacgttactgaacggcgcgcccgcccaggcgtcacgcagataactttcgtaatcggtcatatgaaagtgatagggcgtgtccagttcattcagcgccttcaccgtctgtgggaactgcgcgttcgccagcacctgatcgccaccggctggcagcagcagtttgtcggtgctgcggttaagatcggttaaacggtcgaggatcggcagcagccggtgctctacataatccgcctcggtggataaaaatttccccggcccgtagccgaaatagaggcaacaggcaggcaatgttttctgattcggcgcgcgccagaggaaattcagatcgccgttaagctgatcggtatacacgccgcgctgcaataccgcgtagtcgatccccagatcgccgaaaatcgccgataaatacgcatgctggccgaaaatatccggcagatagccgacgttcatactgtgaccaaagcgctgcgccgtggcgatgccgtactgcaaattgcggatcagggattcggtgcggatcagcagggaatcacactgcgtataccaggggccgacgaacagccgccgctggctgatgagcgcctccagccgcggggcgttttccgggcgcacctgtaaatattcgtccagcaccaccgccagcccgtcaaaggtgaaggaggggaatgttggatcgcgctccagcaggtcgatcagataatccatattctctatcagcagaatatgggagtcctcgcaggtgaaataccactccgcatcccagtggcagtgcgccaccacataaacctcttttttcatcgttttatctcagctgttcaatatgcattttgccggcgcggatcagcgcgtagcgcacgaagacgttggccagggcgataaagctaatgcccgccgccatgccgcacaggtaggcgggcaggttctgcaccagcggccagccccagatggcgggcagcggataccactgcaccgatcccagggtgatggccgtcagcgcgccgatcaccgcgccggtgatattgatggaaatggtgatcagcggatttttcagcatgaaggggatcgccccttcgccgatggcaaggaaacccaggatcaatgaggtggtgccggtgatgcgctggttttcatcaaacacgcgctggcgaacgatcatgcggtcgatcagcgtcgccagcccgatgccgatgggcgggatcacgatccccagcacacgggcggtaaggggatagatatggtcggcggcaaggccgatggcgatcgctccggcggatttgttgaccggcccgccgagatcaaaggcggtgagggaggcgatgatcgccgccagcatcaatgtgctgccgctgccgtgcgccacgatcatctgctgcaaccactggttaatgccgccaaataccggatcgacaaagctgtagttgataaagaaaatcgccagcgcagagaggccgggcacgatcagcatgggcttcatcgcctgtaaatgtttgtgcaggcggatatgggtattcagatagtccgcaaggaaaccggcgatcatgccgaggatcagcgcgccgagaaagcccgacggaatgccgccgctcaccgaccagaaagtgtaatgcaggccaccggcaaaggcgccgccgataaaacccggcaccagaccggggcggtcggcgatgctgtaggccatgtacgcggcgaagaccggatacataaacttcatgatcatgttgccgtattgcgtcaggaaatggcagagcaccagcgcggtgctatcgctctttgcatagctggcgctgccgatatccgtcacccccagcaggctggcggttaactggccgacgccgatcatcagccctgcggcgacgatcaccgggatcatgtatgaaataccgctggatattccctgatacagacgggcgagaaaggatttctcccgcgtgcgcgactcgctgctgtcgccgtcagcgctgacaatgccgtccggctggcgcagcagacggtcgatcaggccgtccgcgtctttcagcggttctgacactgaagtggcgatatagggcttgccgttaaaacgcgctttgccttttggcggcagggtggcggcgaaaatcactccggcggcagcggcgatctgcgcgtccgtgacttcatcctcggtaccgttggcaccctgtttttcgctccacacctgaatgccccgcgccgcgcccgctttttccagcgcttccgccgccatataggtatgtgcgatgcccgccgggcaggaggtgataacaatcaggctttgcccgccggcagtcaccggcgtgctggcgcgggaagcgttggtgtcatccagcagcgtaagaaaatcctccactgtggccgccgctttcagcgccgccacccgctgctcatccatcagcgacaggctgagggtggagagcaggcgcagatgtccggcgtcatcgccgaagggcaccgccagcaaaaagatcagctccacctgatcttcaccgtccatggtgggccagtcgcgcaccggctgcgtaacgcgcgccaccgcaaaggcggggcgggcgaccacggcagatttgccgtgaggaatggcaacgccctgttcaaagccggtttccgacagcgtctcccgctgccagaccgcctccagaaacgccgccttatcgctgactttgccttcgtcatacaggcgctggcaaagctgatccagaatggtcgcgcgatcgcgccacggctgatccagcaggatcaagcgttcagatgtgatgctgcgtagtgacataacccctccccataaatgacatccgtgcctgctgcgcgggtggtttttaatcaggttaatcgattaactttaaaaatgaaggctggttaacgcgattaacccggcagaatccacattaagacaccggttaccgccaggaatgtgagggctatcaccggacaaaagcctctgctatggttattcgattaaccttcacaggatgaggagcaggcaatggcgacgatcacgctggcgcaggtggcggcaagggcaggggtatcaacggcgaccgtgtcaatggtgctgcgtaaccgcgggcgtatttccccgtccacgcggcagcgggtgctgaaagcgctggatgagtccggctatgtctataaccagacggcggccaacctgcgtaaccgcagcagtaatcaggtcggactgctgctgcacgacatcaccaatcccttttatggcgaaatgaccgcaggcttaagtcacgaaatggagcgccacgatctgctgctgtttctggcgaacagcgaggagtccggcgagcggcagcaaaaatttgtcgattccctgatgcgcaataacgcctgcggcatggtgctgtgcgccgcacgggaaacgccgtcgtcattctttgacgcccttaagcgccgtaacattccggcgatcatggtggtgcgaccggcaagcgatccgcagtttgattttgtcggcaccgataattttcttggcacgcaaatggcgacccgccacctgctcagcctcgggcaccggcatatcgcctttatcggcggcagcgccagctccggcacccgggcgcagcgcatcggcggttttaccagcacgctgcttgagaagggcatttcgccggaaccggcctggctggtgacctcgcaggccagccagagcgatggcgcgcgcgtggcgcaggcgctgctgacgcagtacccgcagatcaccgcagcggtctgctatcaggatattgtggccctcggcgtgatgcaggcgctgcgaaaaatgggccgcgaagtggggcgtgactttgcgctggtgggctttgacgatattactgaagccgcgctggtgcagcccgcgctcaccaccgtatcggtggcggcgaaagagattggccgtaaagccggggagctgctgtacagtcgcattcagggcaataatgagccgccccagcgcattattttaccgcccgcgctggtggtcagggagtcctgcggctttcgctgatcatcatgccttttactgatatttttcggcgtatatcattaaattctaatatcgacgtttttggctggtcgccccgcgcggggctggttactctgaaaacgttttttcagcatttcattaacaaaagagtacaactatgcaagaggcaaacatccgcgtggccatcgcgggagccggtggccgtatgggtcgccagctgatccaggcggcactggcaatggaaggcgtggcgctcggcgcggcccttgagcgcgacggatcgtcgctgctcggcagcgatgcgggtgaactggcgggcgcgggcacaaccggcgttaccgtgcagagcgatcttgaggccgtgaaagacgattttgatgtctttatcgattttacccgcccggaaggcaccctggcgcatctggccttctgccgcgagtacggcaaaggcatggtgataggcaccaccggctttgacgacgcgggcaaagcggccatcagcgaggccgcgcaggacatcgccattgtctttgcggcgaacttcagcgttggcgtgaatgtgatgctcaagctgctggagaaagcggcaaaagtgatgggcgattataccgacatcgaaattatcgaagcgcatcaccgccataaagtggatgcgccgtcaggcacggcgctggcgatgggtgaagccattgcgcaggcgatggataaagatctgaaggagtgcgcggtgtacagccgtgaagggtacaccggtgaacgcgtgccgggcagcatcggttttgccaccgtgcgcgcaggcgacatcgtgggtgaacatacggcgatgtttgccgatattggcgagcgcattgaaattacgcacaaagcctccagccggatgacctttgccaatggtgcggttcgctcggcgttgtggctcaaatctaagcgaaacggtctttttgatatgcgtgatgtgctggatctcaacagtttatagcctttattacctctcgtgatgtggttgtggtaatcataattaattgattacatggggcaatattttattgcccctttatttttgctcttcattgatatttttctattaaacctctaaaagttgcaatcttcttcggtttatttgtttctgtaatgtaaattttgaccatctggtccggttttgcagggtgccagacaaatattccagttttctaaccgcgcaagcgttttcctgcctgatatagctgatcttttcactgcctttgccttctgtggtttgtcagagacgcaaaaacataaataaaaatggtcgaacgggtagacttttgtctcacctgtctctagaatgccgccgtttgccgaaaattcgcgggtaagcaaatttgcattgattcacgggctcattatgaattaatatgcaaataaagtgagtgaatattctctggagggtgttttgattaagtcagcgctattggttctggaagacggaacccagttttacggtcgggccataggggcaacaggttcggcggttggggaagtcgttttcaatacttcaatgaccggttatcaagaaatcctcactgatccttcctactcccgccaaatcgttactcttacttatcctcatatcggtaatgtcggcaccaatgctgctgacgaagaatcctctcaggtacatgcgcaaggcctcgtcatccgtgacctgccgctgattgccagcaactaccgcaatcaggaagatctctcctcttacctgaaacgccataacatcgtggcgattgccgatatcgatacccgtaagctgacgcgtctgctgcgtgagaaaggggcgcaaaacggctgcatcatcgccggtgataacccggacgcggcgctggcgctggaaaaagcgaaagctttccccggccttaacggtatggacctggcgaaagtcgtgtccactcaggagagctacagctggacgcaggggagctggacgcttgaaggcgagctgcctgaagcccgcgcggaaagcgagctgccgttccatgtggtggcctacgactacggcgcgaagcgcaacatcctgcgcatgctggtggatcgcggctgccgtctgacggttgtcccggcgcaaaccccggcagaagaggtgctgaaaatgaacccggacggcattttcctctccaacggccccggcgacccggcaccgtgcgattacgccatcgaggcgattaaaaccttcctcgataccgatattccggtgttcggcatctgtctcggccatcagctgctggcgctggccagcggtgccaaaaccgtgaagatgaaatttggtcaccacggcggcaaccacccggtgaaagacgttgaaaacaacgtggtgatgatcaccgcccagaaccacggttttgcggtggacgagtccaccatgccgtcaacgctgcgcgtgacccacaagtcgctgttcgacggcaccctgcagggcatccatcgtaacgataaaccggcgttcagcttccaggggcacccggaagccagccctggcccgcacgatgccgcgccgctgttcgaccactttattgaactgatcaagacttaccgttctgtcgccaaataatcaggagccataaaagccatgccaaaacgtacagatataaaaagcatcctgatccttggcgctggcccgattgttatcggccaggcctgtgagttcgactattccggcgcgcaggcgtgtaaagcgctgcgtgaagagggttaccgcgttattctggtgaactctaacccggccaccatcatgaccgacccggaaatggccgacgcgacctatatcgagccgatccactgggaagtggtacgcaaaatcatcgaaaaagagcgcccggacgccgtactgccgaccatgggcggccagacggcgctgaactgcgcgctggagctggaacgccagggcgtgctggaagaattcggcgtgaccatgattggcgcgaccgccgacgccattgataaagccgaagaccgccgccgtttcgacatcgccatgaagaaaatcggcctcgacaccgcccgctccggtattgcgcataatatggaagaagcgctggcggttgccgctgacgtgggttatccgtgcattatccgtccgtcctttaccatgggcggcaccggcggcggtatcgcttataaccgcgaagagtttgaagaaatctgttcccgcggcctcgacctttcgccaaccaaagagctgctgatcgatgaatcgctgattggctggaaagagtacgaaatggaagtggtgcgcgataagaacgacaactgcatcatcgtctgctctatcgaaaacttcgacgccatgggcatccacaccggcgactccatcaccgttgcgccagcgcagaccctgaccgacaaagagtatcaaatcatgcgtaacgcctcgatggcggtgctgcgtgaaatcggcgtcgaaaccggcggctctaacgtccagttctcggtgaatccgaaaaacggtcgcctgattgttatcgaaatgaacccgcgcgtttcccgctcttcggcgctggcctcgaaagccaccggcttcccgattgctaaagtggcggcgaaactggcggtaggttacacgctggacgaactgatgaacgacatcaccggtggccgtactccggcctcgttcgagccgtccatcgactatgtggtcaccaagatcccacgctttaacttcgaaaaattcgtcggcgctaacgaccgcctgaccacgcaaatgaaatctgtgggcgaagtaatggcgattggccgcacccagcaggagtcgctgcaaaaggcgctgcgcggtctggaagtgggcgcaactggctttgacccgaaagtgagccttgacgatccggaagcgctgaccaaaatccgccgcgagctgaaagacgcgggcgccgagcgtatctggtatatcgccgacgccttccgcgccgggctgtccgttgatggcgtgttcaacctgaccaatattgaccgctggttcctggtacagattgaagagctggtgcgtctggaagagaaagtcgcggaagtgggcattaacggcctcgacgcggatttcctgcgtaccctgaagcgtaaaggctttgccgatgcgcgtctggcaaccctggcaggcgtgcgcgaatccgaagtgcgcaaactgcgtgagcagtacaatctgcacccggtatataagcgtgtggatacctgcgcggcggaattcgccaccgataccgcttacatgtactccacctatgaagaagagtgcgaatcgaacccgaacccggatcgcgacaaaatcatggtgctgggcggcggtccgaaccgtatcggccagggcattgagtttgactactgctgcgtgcacgcctcgctggcgctgcgtgaagacggttacgaaaccatcatggtgaactgtaacccggaaaccgtctccaccgattacgacacctccgaccgtctgtactttgagccggtaacgctggaagacgtgctggaaatcgtgcgtatcgagaagccgaaaggcgtgatcgtccagtacggcggccagacgccgctgaaactggcgcgtgcgcttgaagccgcaggcgtaccggttatcggcaccagcccggatgccatcgaccgcgccgaagaccgcgaacgtttccagcaggcggtggatcgtctgaagctgaagcaaccggcgaatgcgaccgtgacggccatcgaaatggcggtcgagaaagcgaaagagattggctacccgctggtggtgcgcccgtcctacgtgctcggcggccgcgcgatggaaatcgtttatgacgaagtggatctgcgtcgctactttatgactgccgtcagcgtctccaacgatgcgccggtactgctggatcgcttcctggatgatgcggtggaagtggacgttgacgccatctgcgacggcgaaatggtgctgattggcggcatcatggagcacatcgaacaggctggcgtacattccggtgactccgcctgctctctgccagcctacacgctgagtcaggaaattcaggacgtgatgcgtcagcaggtgcagaagctggccttcgaactgcaggtgcgcggcctgatgaacgtgcagtttgcggtgaaagacaacgaagtctacctgattgaagtgaacccacgtgcggcgcgtaccgtgccgttcgtctccaaagccaccggcgtgccgctggcgaaagtggcagcacgcgtgatggcaggaaaatcgctggccgagcagggcgtgaccaaagagatcatcccgccgtactactcggtgaaagaagtggtgctgccgttcaacaagttcccgggcgttgacccgctgttagggccggaaatgcgctctaccggtgaagtgatgggcgtgggccgtacctttgcggaagcctttgccaaagcgcagctgggcagcaactcgaccatgaagaaaaccggtcgcgcactgctgtcggtgcgtgaaggcgataaagagcgcgtggtggatctggcggccaaactgctcaagcagggcttcgagctggatgccacccacggcaccgcaattgtgctgggtgaagccggtatcaacccgcgtctggtgaacaaggtgcatgaaggtcgtccgcacattcaggatcgtatcaagaatggcgaatacacctacatcatcaacaccaccgcaggccgtcaggcgattgaagattccaaactcattcgccgcagcgcgctgcaatataaagtgcattacgacaccaccctgaacggcggcttcgccaccgcgatggcgctgaatgctgatgccaccgagaaagtgatttcggtgcaggaaatgcacgcgcagatcggtaagtaaattgtcaccccgtcacccggtaaacgcatgttgccgggtgacgcttcgcttgtttctgcctgtctgtttcactgttgttatttcgtaacccattcagagtgttctgtgttttctcccgctcgcagttgtttcatctacagttaaattatccggaacaaaaattcactgaaaacgcggggagaacaccatgcgacataaacttttactggcttcactttttgcagcgacaaccatgatgaccgttgccggttgctcatcaaaccaggaagtaaaaaccaccgacggcagcaccatcgtcaccgacggtaaaccggaagtcgataatgacaccggcatggtctcctataaaaacgccaaaaccggtcagaccgagcagattaaccgtgaccagctgaaaggcatgagcgagctggataactaatctgcaccagcctgataaagacgccctgttacctgccggtaacggggcgttgttttgtaaacggcttataagttttcgctgtaagcgcaaccattaactgtctacactcagggcaaatataagcacggtgcagacaggttactcatgatccttattatttatgcccatccctatccgcggcattcccatgcgaataaacggatgattgagcaggcagagacgctcgacggcgtggaaatccgctctttatacgaactttaccccgactttaatatcgacatctctgccgaacaggcggcggtggaacgcgccgatctcatcgtctggcagcatccgatgcagtggtacagcgtaccgccgctgttgaaactgtggatggacaaagtgctctcccacggctgggcctacggcgagggcggtcacgcgctgcacggtaaacagctgctgtgggcagtgaccactggcggcggcaaacaccatttcgaactcggtgcccatccgggcttcgatgtgctctcgcagccgttgcagtccaccgcgatctattgtggcctgcaatggctgccgccttttgccatgcacaataccttcgttgacgacgacgaaacccttcaggcgcaggcgcgccactataaacaacgtctgactgactggcaggagacacatcatggatagccatacgctcattcaggcgctgatctatctgggatccgccgcgcttatcgtgccggtcgctgtgcgcctcggcctcggatccgttctgggttatctgattgcgggctgcatcatcggcccgtggggtttgagactggtgacggatgcgcagtcgattttacatttcgcagaaatcggcgtggtgctgatgctgttcgtcatcggccttgagctggatccgcagcggctatggaaattgcgcgcttcggtatttggcggcggcgcgctgcaaatgctggcctgcggtctgctgcttggcgcgttttgtatggcgctgggcctgcgctggcaggtggcggtgctgatcggcctgacgctgggactgtcttctaccgccattgccatgcaggcaatgaacgagcgcaacctgatggtctcgcaaatgggccgcagcgcctttgccgtgctgctgttccaggatattgccgccattccgctggtggcgatgatcccgctgatggccgccagcggtgaagccatgacgctcggcagtttttcactttcggcgctgaaagtggtgggcgcgctggcgctggtggtattgattggccgttatgtggcgcgaccggcgctgcgttttgtggcgcgatccggcctgcgggaagtattcagcgccgtggcgctgttcctggtgtttggcttcggtctgctgctggaagaagccggtttgtcgatggcaatgggcgcgtttttagccggggtattgctggcaagctccgagtatcgtcatgcgctggaaagcgacatcgaacctttcaagggactgctgttagggctgtttttcatcggcgtcggcatgtccattgatttcgggacgctggtgacgcatccgctgcgcatcgccgttctgctgctgggtttcctggtgatcaaaaccctggtgctgtggctgattgcccgtccgctgaaggtgccgggaaaacagcgccgctggttcgccgtgctactggggcaggggagtgagtttgcctttgtgatctttggcgcggcgcagacggcgaacgtgctggatcccgaatgggcgaaggcgctgaccctggcggtggcgctgtcgatggccgccacgccgatcctgctggtgctgctgacgcgtctggaaaatgccgctgtcggccagccgcgcgaggcggatgaaattgatgaagaacagccgcgggtgatcgtcgccgggtttggacgcttcgggcagatcgccggtcgtttgctgctctccagcggcgtgaaaatggtggtactggatcacgatcctgaccatatcgaaacgctgcgcaagtttggcatgaaggtattttacggcgacgccacgcgggtggatctgctggagtccgctggcgcggcgaaggcggaagtctttatcaacgccatcgacgatccgaaaaccaacctgcaactgacggagctggtgaaagaacatttcccgcacctgacaattatcgcccgcgcccgcgacgttgatcactttattcgtcttcgccaggctggtgtcgaaaggcctgagcgtgaaaccttcgaaggagcgctcagacttggacgtatggcgctggaagggttggggctgggtcagtacgaggcgcgcgagcgtgccgatctgttccgtcgttataatgcgcagatggtggaagaaatggcgcaggtggataatgacacccagtcccgtgcggcggtgtacaaacgtaccagcgcgatgctgagtgaaatcatcactgaggatcgtgcgcatctgtcgcttattcagcgccacggctggcagggcacggaagagggcaaacacaccggcgatccgcgggatgaaccggcagtgaagccgtcagcagaatgaaaaattttatcattctttaccctgtcgccagtcgacgtgagaatgcgctttacgtatagtggcgacaattttttgcaccgggatacattcaatgatcagtctgattgcggcgttagcggtagatcgcgttatcggcatggaaaacgccatgccgtggaacttgcctgccgatctcgcctggtttaaacgcaataccttaaataaacctgtggtgatgggccgcctgacctgggagtccatcggacgcccgctgccgggacgtaaaaatatcgtcatcagcagcaatccggggactgacgatcgcgtgcagtgggtctcttctgtggatgaggcgattgccgcctgcggcgacgcggaagagattatggtgatcggcggcggtcgggtttacgagcagttcctgccgaaagcgcagcgcctgtatctgacccatattgatgcagaagtggaaggggatacccatttccctgactacgagccggatgactgggaatcggtgttcagcgagtttcacgatgccgatgcgcagaattcgcacagctattgttttgagattttagaccgccggtaatgctctgttccgcccacgcctgaccggtgtgggcggacatccctcagaatgacgccgcttcgtcttcgcccagatccagctggcgattcgaatgctgcgcaaaccaggttttatcttcccagcgcagacaggtcagcacgccgccccagcagcagccggtatccagcgcataaatgccttccggcgtgccttttccttccagcgatgcccagtgaccaaaagcgatgctgtactcttccgccaccggtcccggaatcgcaaaccagggtttcagcggggcaggggcattctccggcacgtctttacagtacatatccagttgcccgttcgggaagcagaagcgcatgcgggtaaaggcgttgctgataaagcgtaaacgcgccagcccggccagttccggcgaccagttgttcggcatatcgccatacatggcgtcgaggaataacgggtaagtgtcgctggccagcacggattcgacgtctctggcgcaggcgatggcggtttccagatcccactgcggtgtaatacctgcgtgggccatcaccagttttttctcttcatccacctgcaacagcggctgacggcgcagccagttgattagctcgtcggcgtccggcgcttccagcagcggcgtaatacgatctttcggcttgttacggctgatgcccgcatacacgcccagcagatgcaggtcgtgattgcccagcaccatgcgcacgctgtcgccaagcgatttcacaaagcgcagcacgtccagcgacgccggaccccgcgccaccaggtcgcccgttagccacagcgtgtccatctgcggatcaaactgcacctgctttaataatgcgatcagttcatcgtagcaaccgtgaacgtcgccaatcagatatgttgacatgtgattaatgaataagtgtagggacggcgagtcggaaaaccggaatggcaatgcggaaagcattcccctgggcatcgatcatttcataatgaccctgcatggtgcccagcggcgtttcaaggactgcgccgctggtgtactgatattcgtcgccggcgtcgatatgcggctgcacgccgacgataccttcgccctggacttcggtttcacggccgttgccgttggtgataagccagtagcgcccgagcacctgcacaggcgtccgccccagatttcgtatggttacggtgtacgcaaagacataacgttcaagctccggtgctgactgagactcaatataaacgctctgtacctgaacacatacgcggggcgaattgctcatgacttaactctccttcggcggcgtattatcaataaggtaattcgccagctggcagtattgcgccacagagatgttctctgcgcgggcgccaggatcaataccaagcgaggcgagaacctcgacgctgaacaaattaccgaggctgttacgaatcgttttacgacgctggttgaatgcttcggtcgtgatacgactcagtacgcgaacctcttttaccggatacggcggcgtggcgtgcggtaccagtctgacgaccgcggaatccacttttggcgctggcgtaaaggccgtcggcggcacttcaagcaccgggatcacctggcaataatattgcgccatcacgcttaaacgaccatacgctttactgtttggtcctgcaaccaggcgattcaccacctctttttgcagcataaaatgcatgtcggcaatggcaccagtatagctaaacaggtggaacattaacggcgtggagatgttatacggcaggttgccaaacacgcgcaaaggctggccgagggtcgtggacagctcttcgaagttcattgtcatggcatcctgctgataaatcgtcagcttaggggccaaaaacggatgcgtttgcaggcgggccgccagatcgcgatccagctcgatcacggtcattttatccatgcgctcgccaaccggctcggtcagggcgccaaggcccgggccgatttcgaccatcgcctgaccgggtttagggttgatcgccgaaacgatactgtcgatcacaaactgatcgttgaggaagttttgcccgaagcgtttgcgggcaagatggccctgatggactctcgtattcattgagtattaataatcattttgatggcgagattaagcgccgtaataaaactgccgacatcggctttcccgtggcccgccagttcaagggcagtaccgtggtcaaccgaggtgcgaataaagggcaggccgagcgtaatatttaccccgcggccaaagccctggtattttagcacaggcaggccctgatcgtggtacatcgccagcaccgcatcggcgcgatcgagatatttaggctggaacagcgtgtcggcgggtaacggaccgctgagattcatcccctgcgcgcgcagttcattgagcaccggaatgatggtatcgatctcttccgtacccatatgcccgccttccccggcgtgcgggttcaggccgcagaccagcacgtgcggttcaccgatgccaaatttagtgcgcagatcgtgatgcaggatggtgatcacatcgcgcagcagggccggggtaatcgcgtctgctacggctttaatgggcagatgcgtcgtcgccagcgccacgcgtagttcttccgtcgccagcatcatcaccactttgctggcctgcgcgcgttcttcaaagaattcggtatgaccggtgaagggcacgccggcgtcgttaatcacgcccttgtgtaccggcccggtcaccagcgcggcaaattcaccgttcaggcagccgtcgcaggcgcgtgccagggtttccaccacataggcaccgttcgccactgacagctgtcctgccaccacgggctcgcgcagcgccacgggtaacagcgttaaggtaccggcgcgttgcggctgcgggggattttcaggttgccagggaagcagcgaaagcgacagaccgagctgggcggcccggtctgtgagaagtgctgcgtcggcgcagaccaccagttccatcggccagtcgcgctgggcgagctgaacgacgaggtcggggccaatcccggcgggttcgccgggagtgataacgacacgctgaacgttcattagttgctcaggattttcacgtaagcgctggcgcgttgttcctgcatccaggctgcgccttcttcggacattttacggttcatcagcatgcggtacgcgcgatctttctgcgccgcatcggtcttgtcgacgttacgggtgtccagcagttcaatcaggtgccagccgaaggaggagtgcaccggtccgctgatctggcctttgttgagcttagtcagcgcatcgcggaatgccggatcgaaaatgtctggcgcagcccagcccagatcgccgccctgattcgcagagcccggatcctgagagaactctttcgccgcattagcaaaggtggttttgccactcttgatgtcggctgcgatctgctcgatcttcacacgcgcctggtcgtcggtcatgatcggcgacggcttaagcaggatgtgacgtgcgtgtacttcggtcacggaaatgctctggctctgaccacgcagatcgttcactttcagaatatggaagcccacgccggaacgtaccggaccgatcacgtcgcctttcttcgccgtgctcagcgcctgggcaaagatagacggcagctcctgaatacggccccagcccatttcgccgcctttcagcgcctgctggtcggcagagtaagtgatcgccagcttaccgaagtcatcaccggcacgcgcctgctcaacaatagagcgcgcctggctttccgcttcgttcacctgatcggaagttgggttttccggcagaggaatgaggatgtggctcaggttaagctcagtgctggcatcgttctgattgcccacctgctgtgccagagattccacctcttgcggcagaatagtgacgcggcggcgcacttcgccgttgcgcacttcggagatcagcatctctttacggatctggttacggtaggtgctgtaattaacgccatcgtaagccagacggctgcgcatctgatccagcgtcatgttgttctgtttagcgatgttagcgatcgcctgatcgagctgctcgtcagtgaccttgacacccattttggtgcccatctgcaggatgatctgatccatgatcagccgctcaagaatttggtgacgcagcgtgttgtcatccggcaattgctggcccgcctgaccggcgttgagtttcacggactgcatcaaaccatcaacgtcactttctaacaccacgccattattgacgacggcagcgactttatcgacaacctgcggcgcagcgaaaccggtgttcgcaaccatagcgagaccgagcagcagcgttttccagttcttcatactttttccatttccattaaccgcaatgcggattacgttgcaaatcaacgacattacaaagtagaacgataaggcagaatgttcgaacgcagcatctgctgggtacccagaccgtagttagaactcaggccgcgcagttcgatgttaaagccgataactttatcgtacttactctggttactttgtggatcccagccgttcagcttacgttcatacccaacgcggatagcgtagcagcaggagttatattgcagaccgaccatctgatccgccggtttgctggtgttggtatcaaaatagtacgcgccgacaatcgaccagcggtcgacgatcggccagcttgccgcgccgcctacctgcgagatgccatctttgtattgatcagaggtgacatcataatttggcagcgccgcctggatatactccgggctggcgtagcgatagctcagctgtaccatacggtcttcgtcgcgacggtattctactgtcgcgctgctggtggctacgttatcaaggcgcgtatcgtactgcaccccgccgcgcagaccccagcggtcagacatgcgccagtaggtatcgcctgcccagaccagcgaaccggtgttgttatctttttcccagttaatattgtcatccccggtacgggactctgagaaatagtagatttgaccaacagaaacgttaaaacgttcaaccgattcgtcatcataaatgcgcgatgtgataccggtagtcacctgattagcagaggcgatacggtcaagaccgccgtaagtgcgatcgcggaacaggccgctgtagtcagactgcagcagcgacgagtcatagtttttaatgccgctctggtcacgataaggcacgtacagatactgcgcgcgcggctccagcgtctgggtaaagttttccgcccagttcatgtcgcgctcgaaaaccattttgccgtcaactttaaactgcggcagcacgcgacttactgagctttcaaggccagctttggtggcattgttatagtcgtcaatattcgtttgctggtaatgggtcgccatgaccttagcttcggtgttcaggctgccccactcgtttgatagtggcaaattgatggtgggttcaagatgtaaacgcgtagcctccggcataatttcattcgcgttaacaaaatgcacagcctgagcatagacgcgggtatcaaagggacccacgtcattctggtagaagttcatatccagctgcggctcagcggaataggagtcgccgctctgggtatcaaacacctggaactgcttggtcgacagcgtggcattgaagttttcaataccgtagcccacgctgaaaatctgcgtggcgtaaccgtcggtgctggaaccgtatttggtggtaaagtcgttgaaataggttggatcgctgactttggtatagttaacgttaaaacgccatacctcatccagcacgccgccatgctgccagtagaacaaccagcggtgacgatcgctctcggtcgggttctcgtcctgataaactttatcagacggcagatagtcaaactccaccagacctgcgcccgcctgggtcagataacggaattcgttttcccactgaatattgccacgcttgtgaatatagtgcggggtaatggtggcatcgaagttcggcgcgatgttccagtagtacggcaggtagaactcaaaatagttcgtggtgctgtatttggcgttcgggatcaggaaacctgagcggcgtttgtcgccaatcggcaactgcaaataggggctgtagaacaccggcaccggcccgagcttaaagcgcgcgttccagatttccgccacctgttcttcccggtcatggatcacttccgaacccaccacgctccaggtatttgaacccggcagacaggaggtgaaggtaccgttatccagaatggtatagcggttttcaccgcgctgtttcatcaggtcggcagtaccacgaccctgacgtcccaccatctgataatcgccttcccagacgttagtatctttggtattcagattcgcccaggctttcggacctttcagaatgacctggttatcgtcgtaatgtacgttacccagagcgtcgacggtgcgcacgggatcggcctggccttccgccacctgctgatgcagctgcatctcgtcggcctgcaaacggctgttaccctgctggacatcaaccttgccggtaaacacggcatcgtccgggtaattgcctttcgcatggtccgcgttaatggtgacgggcagtttattagtatcccctgtcaccagagggcggttatagctcggtacgcccagcatacactgcgaggcaagatcggccgcctgtccgtactggctgtacagagcagaggcaatcatggtggccagaagggtgggaatacgtttattcatacgttgtatttgttgttccgtcatcagtggctttacggcttgcaaacagtcagagactaacttactcaccttcgcagcgctagtgttaatcctgcccgtgatcgagcctgctaaagaaggctgtgcctgtgcacggcatagaatgacgggtatgataatgcaaattttagccgacggcatgacgatttggggagtatatgcagtattggggaaaagtgattggtgtcgccatcgccttaatgatgggcgggggcttctggggcgtgctcctcgggctattgatcgggcatatgtttgacaaggcacgcagccgtaaaatggcgtggtttgctaatcagcgtgaacgtcagtcgctctttttcgccaccacctttgaggtgatgggccatttaaccaaatccaaaggccatgtgacgcaggccgatattcaggtggcaaccctgtttatggatcgtatgaatctgcatggcgactcgcgtgccgccgcgcagcaggcgtttcgcgtcggcaaggcggataactatccgctgcgcgaaaaaatgcgtcagttccgcagcatctgttttggacgcttcgatctgatacggatgtttctggaaattcagatccaggccgcttttgcggacggctcgctgcatcccaacgaacgtgaagtgctgtatgtgatcgccgaagagctgggcatctcccgtatgcagttcgaccagttcttacgcatgatgcagggcggggcgcacttcggcgatggctatcagcagcagtccggcggcgaatggcaacaggcgcagcgcggaccgacgctggaagacgcctgcaatgtgctgggggtgaaacctgacgccgacgccaccaccgtcaagcgcgcttaccgtaagctgatgagcgagcaccatccggacaagctggtcgccaaagggctgccgccggaaatgatggagatggcgaagcaaaaagcgcaggagatccagaaagcctacgagctgattaaagaagcaaaaggatttaaataagcaggcagtctttcccttctccctctcccgggggagaggggctattcagccagaaacagctccagcagcgaattgaggaacagcttaccctgttcggtgatctgccagcaggctgccgactcggtaagatagccaagggcaatggccttatcgatttgcgggcggatcaccgcttcatcaagcccggtgtagcgcgtaaactccgcgcgcggcgccgcttccagcaggcggaagcggttcataaagaactcgaaaggtttgtcctctgccgcgacatcatgctgcttatcaaggtatgtcccctgcatatagccgcgcggatggcgcgttttggcggtacgcaaaatccgcccgtccgggaaggtgactttgccgtgcgcgccgcagccaatgcccagataatcgccgaagcgccagtagttaaggttatgctggcactgatagcctggcttcgcataggctgaggtttcatactgcacatagcctgcggcggtcagtagtttgtcgccctgctcaaaaatatcccacagcgaatcatcatccggcagcaccggcggacgcgagccaaacagcgtgcccggctcaatggtcagctgataccaggaaagatgcggcgggttcagggcaatcgcctggcgcaaatcatccagcgcttcttcaagagactgattcggcagaccgtgcatcagatcgaggttaaaactgcgcagccccagcccggcggccagatgcgccgcccgttttgcttcgtccggcccgtgaatacgccccagacggcgcagcttcttatcgctgaagctttgcacgccaatagagatacggttaacgcctgcccgctgatactcaacgaagcgatccgcttccaccgtgccggggttggcttccatggtaatttcagcgtcagcggcgaggttaagacgcgcccgcacgccgtcgagcagggtttgcatcgccggaccggaaagcaggctcggcgtaccgccaccgataaaaatggtctttacttcacgtccctgggcataggcggcatcggcgtccagatcgctcaacagatgcgccacatagtcgtcatggggcacttcgccctttaacgcatgggagttaaaatcgcagtacgggcatttctgcacgcaccagggaatatgaatataaagactcaggggtggcaaattagccattacgcattgcttccagtaacagtttcagcgcctgcccacgatgggaaatggcgctcttttcttcgcgggtcagttccgcagcggttttgcccagcgaagggacaaagaaaatcggatcgtagccaaagccgccgtttccggcctgctcgcgggtaataaccccctgccagctgccgtggcataccagcggcgtcggatcgtcagcgtggcgcatatacaccagcacacagtggaactgcgcctgacgtttatcgtccggcacgtcctgtaattcttcgagcagtttttcgagattctgctgatcggtagcatcaacgccggagaaacgcgcggagtagatccccggcgcgccgcccagcacgtcgaccgccagaccggagtcgtcggccagcgccggtaaacccgtcactttcgccgcatggcgcgctttgatgatcgcattttcgataaaggtcaggccggtctcttccacggaatcgacgcccagttccgtttgcgccaccacgtcgaggccgaaatcattcaacagcgaggcaagctcgcgcactttaccggcgttaccggtagcgaggacaactttttgcatagtggatcctaattgagtaatgccgcgacgtcagtcgggatagtttgcggatgaataattttaacctgcttatggcggccaagttcgcctttttcaatcaccacctggcttttggcgacgcggaactgtttggcgagatattttaccagatgcgcattggcctggccgtccaccggcggggcggtgatggcgactttcacttcgtcgccatgcagcccgacaatcgcatcccggctggctttcggctgaatatacagccgtaaaaccagcccgtcttcacaggcgcagactgcactcacagcgccatccacagccctggcagcagcatatcgccggtcgactgcaacagctctgcgatacccatattgagcacgtacagcagcagcacgaggatcatcggcgagaaatcaataccgcccatcgacggcagcaggcggcggattgggcgtaacagcggatcggtcagctgcatcagcacgaactccaccgggctgcggccctggcttacccagctcatgatcgccatcgccagcagcacccagaaaatcagcaggccaatggttttaagcaggatcagtacggcggcgatccagataatcggctggaaggtcaccaccataaacagcacaatggctttcagcacgcagagcagaaacgcaaccagcagcgaggcgctgtcaatcggccccatcgccgggatcacccgacgcagcggccccaccaccggctgggtcactttaacgataaactgcgacagtggattgtaaaaatccacgcgggcacactgcatccagatgcgcagcaacaggatcatcgtatagagttcaatgaccgtcgagagcaggaaagtcaacgtcttcatggcgttcctcagttttccttattttttgtgtaatcgcgcgcaccaaagatagcggttccgatgcgcaccatagtgctgcctgccgcaatggcggcgtccatatcgtccgacattcccagtgaaagggtgtcgacggtgggataacgcgctttgagcgcgtcaaatgctacagccatttgccgtgccaccgcaaactgcctttcataatctgacacaggcgcggggatcgccatcagcccgcgcaggcgcacgccgggcaattccgccacctgcgccgccagcgcatccagttcgttcagggcgatgccggacttgctcgcttcgtcactaatgtttatctggatcaggatgttaagcggcgcgagggtcgccgggcgctgctcgctcagacggctggcgatacgcagacgatccacggtatgacaccagtcaaaatgctccgccaccagacggcttttgttggactgcaacgggccgataaagtgccactccagcccggcgacgcccgtctcctgaaagtagcggatcttgtcgacgccttcctgaacgtaattttcgccaaatgcgcgctgacccgcagcgaccgcatctgcgactgcgctcgcaggttttgttttgctcactgcaagcagcgtaacttcttctgaagcacggccgcaacgcgttgccgccgctgagattttatcccgaacctgtgccaggttatgcgctatatcgttcatgtttccaggaggctttatggatatggaagagatcgtggcccttagtgtaaagcataacgtctcggatctacacctgtgcagtgacgggccgccgcgctggcgacgacagggcaggctggaggccgcgccttttccgccgccggatcccgatgccctgttgcaggccacgctcgacgagcggcagcgtgacgagtggcgcacccggcggcaggtggattttgccgtttcgctcaatcagcatcgcctgcgcgccagcgcctttcgccaccatcgcggcatctcgctggcgttgcgcctgctgccggatcgctgcccgacgctggcggcgctggaaacgccgccgctgctgagcacgctactggcgcgggaaaacggtctgatcctggtgaccggggcgaccggcagcggcaaatccaccacgcttgcggcgatggtcaatgcgcttaatcattcgctgcacggccatattctgacgctggaggatccggtggagttcgtgcaccagagtgcgcaatgtctgatccagcagcgggaaatcggcccgcactgcgcctcgtttgccgacggcttaagggcagcactgcgggaagatcccgatgtgattttgcttggcgagctgcgcgatagcgaaaccatccggctggcgctgacggcggcggagaccgggcatctggtgctggcaaccctgcatacccgtggcgcggcgcaggcgatagagcggctggtggacacctttccggcgcaggaaaaagatcctgtacgcagccagctggcgggcagtttacaggcggtactggcgcaaaagctggaggctgacaggcaggggggcagggtggcgctgtttgaactgctggtgaacaccccggcggtggcgaatcttattcgcgaggggaaaacccaccagttgcccggcatgatgcagaccgggcagcaggcaggcatgctgaccttcgcccaaagccaccagcagcgggtggcgcagggcaggctttaaagatcagcgcacgttcagggagtaaacggcgggcagcgccccggcggtggcgacgatctccagacggatgcgcgtggcggtttgcggcgtctcaaaatggtgttcgcagacggagcggtgattgttgcgcacctcggcaagcaaccgctcatcggcccacagacgataatgggtgatgcagtgcggcgtcacggcctgatgatggcccatctgcaccgtttccatagcgttatcaaagtcatgatcctgcaccaatgtcagatgccggaaagtatgcggcgcgggccactgccaggtcacctggggcgcaggatcctgcgcgtcgggcacccagccgttgctgtactgttccgggcgcagccgcccgttaagcaggttatccgggctgaaacagcgcagcggcggatccagtcgcagggcgggcatcacctgatgtggacggcggcgcggtagccagaagtcgaactcatcgacgccgtaatcgccgtcggcgacctggcgggtttgcttcgcgacgcgggcattcaggctgttaaagaccgtcattatgcccggcagtgccgtgtcggtaagggcgatctccacgtcgtcctgcgcctcaaaggcgacgaaaacatactcatcgcgatcgctctgccagcggaaggcgcagcggtgctcgccttcaccggcgacatgcagcacgcactggtcataatgcagttccggcgtaaagttgccggagcgggcgctgcccatcagcgttacgttcaccgtccggcgctgaccggcgcgcagggtaaaggtgagttccggcagcgacgccccggctttgatcggcagcagcagcgccatgctggcagagagcgactgccaggcgccgttgggtggcaactggctgagcggatattcactgctggcgctcacgctggcgcctgccgccgggtcgatcaactgctggcgcgggatataacagccggtggcctgcaaatgctgctggagcgcgccaatattgtcgcgcccggcgagctggcgcggggtgaagccctgctggtggcacagcgcggcggcgcggcctaccacttcccccagcaagccgcaggtgcacatcacccgggcgctgccaaaggcgacgtgggtggcggaaatcaggcgtccggttaagaacaggttatccagcgagcggctgtaaaggctgcgataaggaatggtataggtgcctttactgtgaaattgtcggcagccgtcgtgcgtgctgtacaccccgtcagccggatgcaaatcaatcgaccagccgccgtaggccacggcgtcgtagtggtcacgctgctcaataatgtcctgctggcacagcagatggtcgcccacaaaccggcggctttcgcgcttgccggggatcgcacccacccactcaatggtcatgttgactgcttcagggaactggccggagtttttaatatgatcccagacgccccagacgattttccacaattcccatttgatggcttcgctttcgtgcacggtgtcgagccgtccgccccattccagccaccacagatcgcagccgttcagcgtcgaggtcagccgcttatagcgcgggatagcggtaatgtcaggcagcgcgaaagagggcggaacaaactgcaccgggccgtcagtctgtttggtatagaaatagatcgagtggccgagcttgtggccaaagttatcgccgggggccattttttcgcccagctccgccatatcttccgcgccttcgcggtactccgcgcccgccagatagccgagcacgccatcgccggtggcatcgcaaaactggctggcggccacctcataaaaggtttcattgatcgggttaaaggctttgacctgatgaatacactgctgatacgcctccacttcaaacaccgcagtattaagcagcagcgtcagccccggctggcttttcgccagatccagcagcaccaggtcgaacatcaccgggttaccctctttgttgcgccagaggttctcttcgaggatctcgcccatgatgccgccttcccgcgaccagcggttattgttgcccatatgcgaggtcgcgccgttagcccacagccgtacttcgctggaggcattgcctcccagcaccggcctgtcctggatcagcaccacctgcaagccgtcgcgcgcggcggccagcgccgcgcagagtccggcaagcccgccgccggccaccagcaggtcggttttcagctgcaccgtagggaaggttctcgcatcgcgctggggaaagattttcattatcttgtttccttctgtactggcggtaaaatcgacgttcagaacgcaaaaatggaatgggtgccgctcatgtcgtctcaaccgaatcaaagcctgattgacggcattcgctgtctgcaatacctcgtctccagcggccgggccataggttgtcgcgaactggcgcgcctgatgggcatcaataccacccgcgttaaccgtctgctgatgaccatggcgtccattggcctgacgatgcaggacgaacagcggcgttatctccccggtcccggcattcacgcgctggcggcgcaggccatccgcggttcagcgctcttttcccaggcgctgccgttgctggagcgccatgccccgaaagacatcgtggtggcgctgggcgtgctctgggaggatcaggtgatttatatctatcactcgagtcccgacagacagggcagccaggcgctggcgggttttcatatgctgcccgcttggcaatccgtcatcggcatgtcgctgctggcggcggaaagcgacgaggcgctgatagcgcgtttttctccggaacagtggcagcagctcggtccgcatgtggcgcaacagcgcgcgctcggacgcgtgatctggcatcacgatgacggcgaagtctcaatggcccgcccgctcggttttcactcggcggcgctggcgtttgccgggatgtggcagcctgacgacaaacaagtcaccgcccggctggacgcgctaaaccagctctgtatccagctaacgcaaaaagagtgagcgccaaatcgggctacactgtttcttttatagatacactatcgaaaatgcaaaaagcagggccgtaaagtgtgaggacgatcgagggaatcgtccccgacagcgctcatgcgtgacggggaaggggggatcaaagatgttgttcgaaatagctttcgaggatgatcaccgccgaagcagaatcgacgttgcctttggtgagcgagcgaaagccgccgtgttcaaacagccctgaacgggcttccacggtactcagacgctcatcgtgtaactggatcttcacgccgaaacggccgtggatcttattggcaaaattgcgcgcgcgggcggtcagcggctgttcggtgccgtccatatttaacggcagacccaccaccactgcatccggctgccactctttgagcagcttttcaatcagcttccagtccggcgtgccgtcctgcgctttgatggcagtcagtggccgggcggtgccggtgatacgctggccgatggccacgccgatgcttttggtaccgaaatcaaacgccagtaaggtgccgctcatcaggcatgccccgccacgccaggcatggttgaaatatcaatgccgataagttttgccgcctcgcgccagcggtcggcaatcggcgttttaaagaggatattctgatcggccggggcggtcagccaggcgttgtcgaggatctcctgctccagctggcctttctcccaggaggcgtagcccagcgccaccagcacgtccgtcggctggtcatcggtgcctaaggtttccagcacgtcccgggaggtggtgatcaccgtgttatcggaaatgcggatgctggaggcgaatttggcgggcggcgtatgcagaataaagccgcgatcttccgccagcgggccgccgaggaatactggtttatccaggcggatcgccgggttgcgcgactcaggctgaattttaagtttctcaagcacaccctcaaccttgaggttttccagcggcttattgatgatgatccccattgcaccttcatcgttgtactcgcaaatgtagacaacagcacgacggaagatgggatcctggagagcaggcatggcaatcagaaagtgatgctgtaaattcattgtcaaggttctgtttccggttcaaaaaagcagcaagcgtccagtatgcggggaaagcagcgtgctgtcactagtcagacactggcgggttccctcccgccggatcgtcagagcggattactgaccaagacgcttttcgatggcgtccatcagcatcccggtgatggagatcgggaagacggcttcgatttcacgaatgcaggtcgggctggtgacgttgatttcggtcagacggtcaccaatgatgtcgagaccaacaaaaatcagccctttggctttcagcgtcggggcgacgcggcgggcgatatcccagtcgctgtcgctgagcggacgcggttcgccacggccaccggcggccagattgccacgggtttcgccgccctgcggaatacgcgccaggcagtaaggcacaggttcgccatccaccaccagcacgcgcttgtcgccgtctttgatggcgggcagatagttttgcgccatgcagtagcggctgcccagctcagtcagggtttcagcgatcaccggcaggttcggatcgccttctttcacgcggaaaatcgaggtgccgcccatgccatccagcggttttaaaatgatgtcgtgatgcttttcccagaacgctttcagctgcgccttgttgcgggtgaccagggtttccggggtcagatcggcaaaccaggcggtgaacagcttctcgttacagtcgcgcaggctctgcggcttgttgacgatcagcgtgcctttttcttcggcgcgctcaaggatataagtggcgtagataaattcggtatcaaacggcggatctttacgcatcagcacgacgttaagcgaggcgaggtcaatatcctgctcgctgccgaattcgtaccatttatcgtagttttgctcgacggagagcagacgcgtgcgggcgcgggcttcaccgttggtcaggtaaagatcggccatttccatatagtgcagctcgtagccgcgacgttgcgcttccagcagcatagcgaagctggaatctttcttgatgttaatgtctgcgatgggatccatcacgatgccgagcttaatcattctttttctccgttaccccaaatcgccgaagcgtacttgcagtgcagtaattgcggtgagcgcggtcgtttcagtgcgcaaaacacgtggtcccaacagaatatcagtaaactgatagcgtgcggtcatggcgatttcatcggcagataaaccgccttccgggccgatcagcaggcgaatacggctcaccggcaacggcagcgtgttgatgctggcgctggcgcgcggatgcaaattcagcttaatgccgtcgtcaggctcggcgcaccaggcttccagatccatcgccggacggatttccggtaccacattgcgaccacactgttcacaggcagcgatggcgattttctgccactgctggatcttcttgttcaggcgttcagcatccagtttaacgccgcagcgctcagaaaaaagtggcgtaatgaggcttacccccagttcgatcgatttctggatggtgaattccattttttcgccgcgggacatcacctggcccagatgaatatgcagcggcgattcacgatcgtcggtttccccggacagaacgctgacctcgacgctttttttatccgcacggaggatttcggcgtcaaaaacctgattgctgccgtcaaacaactgaacctgctgaccagcggtcatacgcagtacgcgccccacatggttggcggcgtcatcgttcagcgccacctgctgaccgacagttaaagatcccgggtgataaatgcggggtttacgcatgctagtacttccgtttaatcgctcaataatacgcgccagtgtaagttagctcttttgtgcctgacaagcgcgcagcacgtaagggttgtgatgcccctgcacggcggcgatacggcggtcgcgctcacactcccaactggccaccggatagagtttatcccacgcggtgaaaagctgcgtctgctgacgggacaaagagagctgatactggtcacgcatgtagaaatacgtacgcgcgatagcgcctctggcacgggcaggcggctctgccagcttcgctttgaaatcgactttcatcgggcactgaccgtactggccttcgccgccgttccactggctgtacatgaagttgccgcgatcgccgttcacttcgcctacggaaggttgcaggttatgcatatcgctttccatctggcgatagaccggatctttgctgcaatttttgcggccgccgtcctgccagcactggcgctgatggccgaactgccaggcgggcaccacatgctcccattcgatacggctggcgcggttttcgtttttacgcactttatagccgcaggacgccagatcgacgacgccttttttaccctgccaggtaattttgcagccgcagtaaaaatcgccgggcgcatcggcgttcactttgacgctggccgctttcgcctgcgagaaattgttgatacccccggcaataccgggaaaggaaaggctgccagccagtaaaagggcagcgaaagcaagtttgcgggacatagcctgctccatatctgagtgtgtccgcaccctagcgaaagcggttgtcagatgcaatcagtcagagcataaaagttccgaaaatcaggcctccgccaccagcggctcgccgcagtgcacgcagcgatacacggcttggccgcgcaggatcttgttgtggcggcgcacggtcagctgatgctgctggcaggggcagcggtaagggaaggtattgcggcgcacggacgccagttcaaactgatgagtacggcgcgccggaacgccgagcacgctttccatcatccatttccactctttgccgtgcggcggcacgcggccaaagtgcttccacaccagcagatgcgccagctcatggggcaccacctcgtcgataaaggcctgctgattttccatcagcagcaccgcgttcaggcggatctcatagctttccagccaggcggtgccggcggcagttccccgctgctgatacaccagcgccggttccggataggcgcggttgagtttctgattcgcgagggcgaggttgtcgcgcaggctgcgcataacggcctgttgaatggcgataggaaggcgggtggttttcataacggcagagaatagtgcggtgaaaaaagaagtgcaagaagggcgttgccgggtggcaacgccctgaggcgaacaatcagtcgtgagagccaatctcgcggagtttgcggcccttcatcaggttgcgctcgatatgctccagcgacacatgcttggtttccggcaccagccagagggtcagcacgatgaagaacaggttcaggcccgcgtatacccagaaggtgttggcgttgcccagcgtgttgagcatggtcaggaaggtcgcaccgacgatcatgttggcgatccagttggtggcggtagagcaggtgataccgaaatcgcggcctttcagcggctggatctcagaacacagtacccagatcagcgggccggcactcatcgcaaaaccaacaatgaacatcagcagcataccgacagccacatactgttcggtcggggtatcaatacccacatgcatcatggtacccagtacgcccatgccgaccgccatcaccaggaagcccagcgtcagcgtcggtttacggccccagcgatccaccagaccgatggcgataaaggtcgccagcacgttggtcacacccacaataacggtgccccacatctgctcggtggtattggaataacccgccagttcaaagattttcggcgcgtaatacatgattacgttcataccggtgaactgttgcatcacctgtaacagaatgccgaggaacacggcgcggcggaagttgctgttctctttaaacagcgcccagccgctctgcttaacctgcaggctttcacggatctcatccagttcgtttttcgcttcggcgctggtatcgcgcagacgcagcagcacgcgttcggcatcatggaagcggcgtttcgcggcataccagcgcgggctgtccggcaggaagaacacgccaatcagcagcagcacggccggtatgatgatcacgcccagcatccagcgccatgcgccgctgtagctgaatgcagtgtcagacagataagcgccgagaataccgatagtgatcatcaactggtacattgagatcatgctgccgcgaattttttctggtgcgatttcagacaggtacagcggagcggtataagaggccacgccgaccgcaaggccgagcagcacgcgcgagaggatcagtacttcgacgtttggcgcggcggctgagaacagcgaaccgatcacaaacagcaccgcaccgatcatcaggctctttttacgcccgagacggaaagacagccagccgctacccacagcgcccacggcggcaccgaacatcatggaactcaccacccattcctgcgtgtgcgggctaattttaaactcatcggtaatgaagggcagggcccctgcgatcacaccaatatcaaggccaaacagcagtccggccagtgcggcgaggaaacagacaaaaaacgtcattgccttgttagaacgccccttttttttattatcaggcatatcgcctccggttaagtcacacatttatcgacgtaaaggttaggtgagcaagctattgttttgtgtgatgtaaatcacgctagtgtaatcggttacaccccgcctgcaagactaattgttaaattaattaaatttatcaatagattattatagttttgcaaatcccatgtgaaagtacattcagattaaaccgaagcatgatgtaacaggaggttaaaaatggctgaaaaaacgcaacagggcaggggatggcaggtcaacggtgatgtaatcgctttcagaaaaagacgaactggggcacataaagtatagaccgctcggcaggcggatgggccaggaaaaagcgtaaaaaagcaaaaggccagcacagggctggcctttattacgcgactgtcagcagattatttcaggccggcagcgtcacgcagcacggcagctttgtcggttttttcccacgggaaatgttcgcgaccaaagtgaccgtatgccgcggtttctttgtagatcgggtgcagcagatccagcatctggatcaggccgtacggacgcaggtcgaagaactcgcgcaccagcagggtcagctgttcggtagcgattttctcggtgccgaaggtttccaccatgatggaagtcggttcagccacgccaatcgcgtaggagacctggatttcacagcgatccgccagacccgccgccacgatgtttttcgcaacgtaacgcgccgcgtaggccgcagagcggtccactttcgatggatctttaccggagaaagcgccgccgccgtgacgcgccatgccgccgtaagtatcaacgatgatcttacgaccggtcaggccgcagtcgcccatcgggccgccgataacaaaacggccggtcgggttgatgaagaatttagtggattcgttcagccactcctgcggcagaaccggcttgatgatctcttccatcacgccttcctgcagggctttctgatcgatatcttcagcatgctgcgtggaaagtaccacggcatcgataccgacaattttgccgttgtcatactggaaggtcacctggcttttcgcatccggacgcagccatggcagggtgccgtttttacgcacttctgcctgacgctgcaccagacggtgagcgtaggtgattggcgctggcatcagcacgtcggtttcgttggtcgcgtaaccaaacatcaggccctggtcgcccgcgccctgttccagcggatcggcacggtcaacgccctggttgatgtccggagactgtttaccaatcgcgctcagtacggcgcaggaattggcgtcaaagcccatgtcagaatggacataaccgatgtcacgcacggttttacgggtgatttcttcgatgtcgacccatgcgctggtggtgatttcgccacccaccagaaccatcccggttttcacataagtttcgcaggcgacgcgcgcttttggatcctgttcgaggatcgcgtccagtacggcatcggaaatctggtcagcgattttatcaggatgtccttctgagacagactctgatgtaaaaaggtgttttgccatgttctaagtcaccctggggtaatggtataagctcaaactctgtgccggggccgtcgatgcggcatgcaggttaatgacacaggaagtctaagtgttaatctgtatagatggattaacatctggacggctattttaggtcaattcttgagcccatttccagccttttttgagattcgtcgcattcttcataacagcccaacggcgaattttacttatatgcctgcaaagcctgcttttttattttgctttttgccccctttgacggtataaaacgccgcacgcggcttatcccttgcggcgctttgcgccagggtataaaaaagcgcacgacaacgtttcgtgtcgccacttccagccgggttgagcagttaaattcgcttgggcttatcgctgaccagaccccggttggcgtggaggtgataccagataatgaaccgttgtttaccgctagatctgccatgccgtccggccgggcatcttactcccgctacctgcatatcttcattgcaatcctgccgatgtttaacccatctcggcgcttctcaggactccagagccggtaaggccctgtaatacctgaacaagggcgctcctgttgatcaggggttttctcgtggtttcgctgaaccgtcataatctggttcggatacgtgttttaaaatgatatgaacaagaaaccggtcgcgcagtcggcgtaccagcatagtctgctggccactccgcctgtttatgggttgttatcgctgtgttacgctgcgatagtagtcaactgttttatatccacggtctttcgtgcggcaagggtaattccgacttgcggtaagccgaatttcacagggtatacactttcaactatgtttgaggttcgctatgtctgacgacatgtcttcgccatccccttcgtcagcaggcgaacagggtgtactacgttccatgcaggaggtagccatgagctcccaggaagccagcaaaatgctgcgcacctataatattgcctggtggggcaataactattacgacgtcaacgaactggggcatatcagcgtttgcccggatcctgacgtaccgcaagcgcgcgttgatcttgctgaactggtaaaagcgcgtgaagcgcaggggcagcgtctgcctgcactgttctgcttcccgcagatcctgcagcaccgtctgcgttcaatcaacgccgcctttaaacgtgcgcgcgaatcctatggctacaatggcgactacttcctggtctacccgattaaggtgaaccagcatcgtcgcgttattgagtccctgatccactccggtgaacccctgggtctggaagccggttccaaagcggaactgatggcggtgctggcccatgccggcatgacccgcagcgtgatcgtctgtaacggttataaagaccgtgaatacatccgcctggcgctgatcggcgaaaagatgggccacaaggtctatctggtgatcgagaagatgtccgagatcgccatcgtgctggacgaagccgaacgtctgaacgtcatcccgcgccttggcgtgcgtgcgcgtctggcgtcgcagggctccggtaaatggcagtcctccggcggtgaaaaatccaaattcggcctggctgccacccaggtgctgcaactggtggaaattctgcgtgaacgcggtcgtctggacagcatccagctgctgcacttccacctcggctcgcagatggcgaatattcgcgatatcgccaacggcgtgcgtgaatccgcccgtttctacgttgagctgcataagctgggcgtgaacatccagtgcttcgacgtgggcggcggcctgggcgtggactatgaaggcacgcgctcgcagtccgactgctccgttaactacggcctgaacgaatacgccaacaacattatctgggcgattggcgatgcctgcgaagagcacggcctgccgcatccgacggtgatcaccgagtctggccgcgccgtgaccgcgcaccataccgtgctggtgtccaacatcatcggcgtggagcgtaacgaatacaccgagccgaccgcgccgtccgaagacgcaccgcgcgcgctgcaaagtatgtgggaaacctggggcgaaatgcaccagccgggtacccgtcgctccctgcgcgaatggctgcacgacagccaaatggatctgcacgacattcacgtcggctactcctccggcgcttactccctgcaggatcgcgcctgggcggaacagctctacctgagcatgtgccacgaagtgcagaagcagctggatccgagcaatcgcgcccatcgcccgattatcgatgagctgcaggaacgtatggcggataaaatttacgtcaacttctcgctgttccagtcgatgccggatgcctggggtatcgatcagctgttcccggtgatgccgctggaagggctgaaccaggtgccggaacgtcgcgcggtgctgctggatattacctgtgactcggatggcgctatcgatcactatgtggatggcgacggtattgccaccaccatgccgatgccgcagtacgatccggaaaacccgccgccgctgggcttctttatggtgggcgcgtatcaggaaattctcggcaacatgcataacctgttcggtgacaccgaagcggtggacgtgtttgtcttcccggatggcagcgtggaagtcgagctgtctgacgaaggcgataccgtggccgatatgctggaatatgtgcagctggatccgaaaacgctgttaacgcatttccgcgatcaggtgaaacaaaccgatctggatacggatctgcaacagcagttcctcgaagaatttgaagccggactgtacgggtatacctacctggaagacgagtaatcgactcccgcttcgcccctaatccctttctcgtcgggtttaacgacgcggaggggattttttttatatcgactttacgaaagaggtcacagacatgagcaccttaggtcatcagtacgataactctctggtatctaacgcctttggttttttacgccttccgatgaatttccagccgtatgacagtgatgctgactgggtgatcaccggtgtaccttttgatatggcgacctccggccgtgccggtagccgtcatgggccgggcgcaatccgtcaggtgtccaccaacctcgcctgggaacacaaccgtttcccgtggaacttcgacatgcgcgagcgcctgaatgtcgtcgactgcggcgatctggtgtatgccttcggcgatgcgcgcgaaatgagcgaaaaattacaggcccatgcggaaaaactgctggcggccggtaagcgtatgctctccttcggcggcgaccacttcgtcacgctgccgctgctgcgcgcccatgcgaaacacttcggcaaaatggcgctggtgcatttcgatgcccacaccgacacctacgcgaacggttgcgagttcgaccacggcaccatgttctacaccgcgccgaaagaaggcctgatcgatccgcaccactccgtgcagatcggtatccgtaccgagttcgacaaagacaacggctttaccgtgctggatgcctgccaggtgaacgatcgcagcgtggacgacattctcgcccaggtgaaacagattgtgggcgacatgccggtttatctgagctttgatatcgactgtctggatccggcgttcgcaccgggcaccggcacgccggtcattggcgggctgacctccgatcgcgccattaaactggtgcgcggcctgaaagatctgaatatcgtgggtatggacgtggtggaagtagcaccggcttacgatcagtctgagatcacggcgctggccgccgcgacgctggcactggaaatgctgtatatccaggccgccaagaaaggcgagtaatcgggctattttactcgccattatgggccagggcagtgctcgccatcctcacgtaccaggtgtacgctccggtggctgcgcgctggcctgacccagactggcttcgccaattacgcccgaacagatttatttgatgccgtctgccgccatgcgatcacgaatatgctgcgcacgcgcttcggacgccggatggtcgtcaaacattgaactttgacggcctgcttccagtttagagagcttctcaaagctggttgccagaccggccgggctgatgccgcgtttgcgcaacagatcgtaagagtagtcatccgcttcggattcctggcgttgcgagaactgggaattgaccagtttttcacccagatcgccaagctgcgactgcgacagactacccactacgccaccggcagacgccgccgccacgcgcaccgcgttggtacccagcgccacctgcatgccgcgcttcacatgaccaagcgccacgtgacccatttcatggccgatcaccgcttccacttcgttgtcgttcatcatatccatcaggccgctgtatacgcggatgcagccgttcgccatcgcaaaggcgttcacatctttcgtctcatagaccttgtagttcacggcctggccgttgatgttgtcgcccagcgcgttggcgattttcgccagacgctggctgtaagcgctgctggccggggagatcgtcgctttgctgtccatctctttacaggcttcatcgcttaacgcaattacctgctgatcgcttaatgagtaggcctggaacgcttccgcgccggagctcatcaggccgttagaatccatgttctggcagccggtcaacgccgttgccacacccagagcaagcaatgctgtgcgaatcttcatgtcttatcttccgcaataattaatgcatattttgttagtcgccgcgcctgaacgaagcgggctggtgcgctgagtataaagaatagaacgggatggcggcgagcgtttgcgcaacttgcgagcatgatccagagatttctgaagcggcaaaaggatgctccatgtacatgagttgccgcttgggttacattgttgtcacttttttccggcgtagcccattccgcgctgtagtcaagtcgccagggcatggcctttaacagtccgatctggagtcaaaatgtcctcacgtaaagagcttgccaacgctattcgtgcgctgagcatggacgcagtacagaaagccaagtccggtcacccgggcgcccccatgggcatggcagacatcgccgaagtcctgtggcgcgatttcctgaaccataatccccagaacccgtcctgggctgaccgcgaccgcttcgtgctgtccaacggccacggctccatgctgatttacagcctgctgcacctcaccggctacgatctgccgattgaagagttgaaaaacttccgtcagctgcactccaagaccccgggtcacccggaagtgggctacaccgccggtgtggaaaccacaaccggcccgctgggtcagggcattgctaacgcagtaggtatggctatcgctgagaaaaccctcgcggcgcagtttaaccgcccgggccatgacatcgtcgaccactacacctacgccttcatgggcgacggctgcatgatggaaggcatctcccacgaagtgtgctcccttgccggtaccctcggcctcggcaagctggtggcgttctatgatgacaacggcatctctatcgacggccacgtagaaggctggttcaccgacgacaccgcagcacgttttgaagcctacggctggcacgtggtgcgtggtgtggacggtcacgatgctgacgcgatcaaacgcgccatcgaagaagctaaatccgtaaccgacaaaccatccctgctgatgtgcaaaaccatcatcggtttcggttccccgaacaaagccggtactcacgactcccacggcgcgccgctgggcgatgctgaagtggcactgacccgcgaacagctgggctggaaacacgcggcttttgaaatcccgtctgacatctatgcgcagtgggacgcgaaagaaatgggcgcggcgaaagaaaacgcctggaacgagaagtttgctgcctacgcgaaagctttcccgcaggaagcggcagaattcacccgccgtatgaaaggtgaaatgccggaagatttcgccgcgaaagcgaatgaattcattgccaaactgcaggcaaacccggcgaaaatcgccagccgtaaagcgtcccagaatgcgattgaagccttcggcccgtggctgccggaattccttggcggttctgctgaccttgcgccaagcaacctgaccatctggtccggctcgaaagcgattaacgaagacgccgcaggtaactacatccattacggcgtgcgcgaattcggtatgaccgccattgccaacggtatcgccctgcacggcggtttcgtgccgtacacctccaccttcctgatgtttgtggaatacgcccgtaacgcggtgcgtatggcagcgctgatgaaacagcgtcaggtgatggtttacacccacgactccatcggtctgggcgaagacggcccgacgcaccagccggttgagcagatcgcttccctgcgcgtcaccccgaacatgagcacctggcgtccgtgcgatcaggttgaatccgcggtagcctggaaatacggtgtagagcgtcacgacggcccgaccgcgctgatcctctcccgtcagaatctggcgcagcaggatcgtactgagcagcagctggcagacatcgcccgtggcggttatgtactgaaagacagcgacggccagccgcaggtgatcttcatcgccaccggttccgaagtggagctggctgtaggcgcatgggaaaaactgactgccgaaggcatcaaagcccgcgtggtctccatgccgtctaccgatgcgttcgacaaacaggatgcctcttaccgcgaatccgtactgccgaaagccgtctccgcgcgcgtggcggtggaagcgggtatcgctgactactggtacaaatacgttggcctgaacggcgctatcgtcggcatgaccaccttcggcgaatctgccccggcagagcagctgtttgaagagttcggcttcacggtcgacaatgtggtaagccaggcaaaagcactgctgtaatcgttgttgttaagaaacgggtcgctcaggcggcccgtttttttctatccgcttcatcacttccagtaaattatcaatcgatcgtccctgattaataaagatcgccatattaaacagcaaatcaataagccaggtttgcgatgctttgatcatagacgcatcgctttcatagcgattctgcgaccctccagttaataacgtgacatcagcaaaggacgttaaaggtgaatgcaaatagcgggtgattgccagcgtgctagcgccattctgctttgcgttctgaaaagcatcgaccagatcgcgcgtttctccggtatggctgatgcctattaccagatcctgcttgcccaccagcgcagaattcagcagcatcgtatggttatccgtatgcgcgtcaattcgcatgccgatgcgcataaagcgatactttgcctccagcgcgctgatgcccgacatgccgataccgtacacattgatctggctggcaccgagcagcaaagtcgccgcctgctccagggtagcgttgctttgcagcgccagggtttcgtccagcgatgcctgattaagctgatgcagccgacgcgccacgtccagtaatgagggctgttcggcgggactgtcgctttgaggcagcggttgtagcgactggagctgttctgcggtcagttctcttttcagcgccgcaaaacctgccaggccaatcttgcggcaaaagcgcacgatcgtcgcttcgcccagctgcgttgcgctggcaaggctcgcgatattgcgcatgatcacctgctgctgatgggccagaatataatccgccagccgctgctcggtgcgggtgagttggttgtgatgcattttaattaacgcactgatcgacataaacatcctttaatcacggctgggcgatgatgggggttttaaagagacggtaaaagccaggccgctcatccgtttgaagggcgcgcgaacctcgtcgatgacgagctgctggccagaaaaactgttgtgcagcgtctgctgccagcattgtttaacgcgcgtggcaatagtcgccagaatagccgcttcgtgtttgccgaactgcgcatagctggcgcccagcgcaggcagcacggtttcctgtaccgcaaatcgcacttcgctctgataagcccagtccgacaccagacgttccagcataaaattgcgtgcctgctgcgggcggtcgccgcgacaggcgaaggcgagggcggccagtacggtgcccagcgtattacaggcagtgttccagcctgcataggcgctgaggcgatccagcaggcgatggtgatccagcatttcaattaactcccgctcgccgccgttgctgaaagcgacatcggcaatgccgaccggtttgccaccaatccatgaagccagcgtgtcgcaaaaggcggtaaggctgcggttacggtaataagagagcgctttattgttctgctgcatccagccctcctgcatcaccccgccgcagccgttgatgcccagcagcgcgtccgcatttgccggatcatcacaaagggcaataccgcaggcgcggctgtgggagagcaggctctcttcaaaaggtcgatcttcatactcaggcacaaattgccgaaaagcctgattcgaccagcagaccgcaaatttcagccgcgttggttgccgtgtaagccaggcccgggtcagtaaggtacaacctgattcgtcggtgccggggtgcagccagacgcgatcctgcaggcgattcgcggcgatagcccggtaaagctggcgctgatccatggcggtatagccaaagggcgaggcgtcatcctgtgggatcagcagacacgccagcacaccatcagtaaccagctccaacgcggcctgcgtgacggcgatattgtgctgccgacgctgttcgaaatccgttcttgctgcgctgtccagctctgccgccagacgctgatactccagctgttcttccgccgtcagcagaccctgtgcgtcgcggtcgcggtaaatgccgtactgccagatggcccggccacagtgcgcataataatccggctcttcttcggcggaatcataggcgggggtacgcaggatcagcgaggaggcggagatttctactgccggataacgctgatggagctgacgcagccagtcaaggcgcgcgtgcagcgcctctggcgttaaatgatgcgtacgcgcaggcagcaggccgccgtaaatcagcatatccagcgacaggatcagcgcatcggcaccagccatatgcgcctcgataaacgcggtgagcgcggcaaagtgggcgggtgttttgcggaaaccgagcaaatcacgcggcggcatcactagcgtcagctggctatccatcgccgccagcgactgtagaaaatcgtagttataggggcgggcatccagcggcagacagacaattttcatccgttatgctccttgttccgcttgtttctggcgattcagcgccagcacgaaaggcagatagatcaacaccgaaagtatcagcaacagcagggccagcagcgcggcgcgccagtccccgcccgtggcgagaaatgcggagagcactggcggcgtggtccaggggatcagcacggtggttttatcgatcagctcaagcgcggtggcgaaccaggcgatgccgacgctcaggagcggcgtcagaataaagggcaccagcagcagcggattaaagataagcgggatgccaaaaatcatcggctcattgatgttgaacaacgacggcacgccggaaagccgggtgatggtccggtgatcttcccggcgcgaggcgatgagcatggcgataaccaatccgatggtctgcccgccgccgcccatatatccgaaagcgtcaataaaaggtttggtgacaatgtgtggcggaacagcgccctgctgaagcgcggcggcgttttcctggatcgccaccagcagcgttggctcggtgatcggcatcatgatcgatacgccatggatgccgaaaaaccacagcatattcatgctgaacagcaggccgagcacgccatgcagactttgtaatgcgttttgcagcggcgcctgcacaacctcgttcaccagatggtgcaggttagtgccgaaacatacttcaattaacactgccagcaggccaaacagggtgagcagcaacaacatgggaagaataacgttaaaagagctggctacagcgggtggaacgctgtcaggcatgcggatcgccagatagcgactgcgctgcgccagcgtcaacagttcgctgcttatcagggcgatgataatgccgacaaacaggccgctggcggcggtttcgctggcggcgataaggccgggaacccgaacgatttgatccgccatctgcaacgtctgctcaagggggaaaaagatcaccagacaggccagcgcgaagaccgcatgaatagctcccgcctgttcacgcgcgagcgccatgcgccacgctatcatcgctgttgcgagtagcgtcagaatattgagcgtgccattgtaaatgcgtataccaatttctctggcgggaacaagccagtcggcttttataccgagcagtcccatcagcccggctttttcattcagtaccacattattgatgagtacaaaaaacgaggcggctatgatcagcggcatcagaaaaataaatccttccctgatcgccgtgagatggcgctgcgccgccattctgcctgcccagtaagccagcctgtcgagtgccgcgctggcgttaaatccctttatcatttttcctcctgagtgtttggctccacaagtgcggcggcggcattatggaaaagggcgcggaagaaaagcatgaaggcgatcacgcaatgaatttttaactccagttttttaaataaaatggagttaattcttcacttatgaataaaaaatgttgcgtcgtggctcatggcagagttacggtgcggcgatccccagtaatgccgaggcgggcgactgcccgctcaccagcgcctgggtgctgccgtcccaggcaatgcgcccgtcggcgatcaccagcgagcgcggggcgatgcgcagcgcatcttccacactgtgcgacaccatcagcagcgtcaggttctggcgctgacacacctcgttaaccagcgccagcatctcctgacgcagcgccggatccagggcggaaaacggctcatcaagcagcaataccggctgttcgcgtaccagacagcgcgccagcgccacgcgctgacgttgcccgccggagagctgatctggcagacgatcgagcagcgatcccagccccatctgcgcggcaatgaccgcgagagtggcgcgctgggtgtcgttaagttttaagccgggatgcagccccagaccaatgttctgccgcaccgtcagatgggtgaacaaattgttttcctggaacagcatcgacaccgggcggctcgacggtggcgtacgcgtgtgatcctcgttttccagcatgatcgagccgctgtccggctgtaaaaacccggcgatcagattcagcagcgtgcttttccccgcgccgctcggcccgaggatcgccacctgttcaccccgctcgatattcagcgtaaagcgcatgggcaggtgatggtaaagccaggtggtatcagtcagttttagcatggcgacccggaagtttttcaatcacggtgaacaggataaagcacagcgccagcagcagcagcgccgttacggccccgtcctggctgcgataagagcctatttgctgataaaggtaaaacggcagcgtgcggaaatcgtcattgccgaacagcgccacgacgccaaaatcgccgatcgacagcacacaggcaaacgccagcgcctgcgccagcggacgtttcagcgcgcgcagctccaccacgcgcagccgttgcagccctgccatgccgagagactggcacagcagcgtataacgggcggcgacatcgcgcatcgggttttccagcactttcagcgcgtaggggatggccatcagcgcgttagtaaaaatcacaatgccgtcggcagagtccggcaggccggtggcgttgttaagcagtaaaaagaagccggtcgccagcacgatgccgggcattgcgaggatcaacatgccggacagctccagcgcctgcccggcgaagggttgctggcgggcgcgcagttcgcggctgctccacagcagcatcatggtcaggatcacacacagcaccccggcgcacagtgcgatgcgcagcgaggtccaggtcgcctgccacagcaccggctgcgccagcacgtccagcaggctgcgattcaggccttcgaccatcacggcaatcagcggcggcagcaacagcaacagggccagcacaatcagcgtgccatcggcgaggcggcgcaacagactgtcctgcggatcgcgccagccggtgaggtgatttgtgccgacggcaatggctttgctcagccgctggcttaacagcaccagcccgagacagcagatcatctgcaccagcgccagcaacgccgcgcggcctggttcaaagtcgtaactcagcgcctgataaatcgccagctcaatggtggtggcctgtggtccaccgcccagcgacagcacggtggcaaagctggcgaagcagagcataaagatcagcgcggccaccggcgggatttgccgccgcagccagggccattccacaaagcggaaaaacgcccagccgcgcatcccgagctgggcggcaagctggcgctgctcgccggggatctgctccagcgcctgtaacagcaggcgggtcgccatcggcaggttaaagaagacgtgggccagcaggatcccctgcaggccataaggcgaaaacgtccagtgcgatccgaaaatctgcgccagccagccctgacggccatagacgctgagaatgccgaacaccgccaccagcaccggcaaaatcagcgtcatggcgcacaggcgcaacagcatttgccgccccggaaagcgacggcgatacagcgcgcgggccagggaaatcgccggagccaccgacagcagggcggataaaaacgcctgccagaacgagaagcgcaccacgtgccacaggtaactgtcctgccacagcgcggcgacgtccgttaccggcgcattcagccacagcgcaaaaaaggccgccagcgccaccgccaccatcagtgtggccgcggcggcaccgggcagcagccagccgggaattaacggctgacggcgcgttgccatgcactgatccagtcggcacgcttcgcggcgacatcctgcggggagtattccagcgtggtggccggtttcaccagctggtcaaagcccgcgggcagcgccacgctggtcaccggatacatccagttgccggtggcgatagtgttctggaacgccggggtcaccataaatttcaggaacttcttcgccagttccggctgcttgctggcggcggtgcgggcggcaacttccacctgcaaatagtgaccttcgctgaagcccgcggcggcgtagttgtctttcttctcttcaatggcgtgatacgccggggaggtggtgtagctcagcaccaggtcgctttcacctttcaggaacaggccgtaagcctcgctccagcctttggtgacggtgacggttttcgcggcgagtttttgccaggcgtccggcgtcttatcgccatagactttttgcatccacagcagcaggccgaggcctggcgtgctggtgcgcggatcctggtagatcacacgccatttctggtcgctttccaccagttctttcaggcttttcggcgggtttttcagtttgtttttgtcatagacaaaggcgaaatagccgtaatcgaacggtacgaaggtgtcgtttttccagccgcccggcacgttcactgcatcattcgggatgccgcttttcgcaaacagtttagtttgcgtggccgcttccagcaggttgttatccagccccagcaccacgtcggctttgctgtttttgccttccatgcgcagacggttgagcagcgagacgccatcttccagcgccaccagcttcagctcgcagttgcagtccgcttcaaaggcctttttgactttcgggccagggccccagtcagcggcaaaggagtcgtaggtgtaaacggtaagaacgggtttggcaaaggcgggcgcggcaatcagcagcaggaacggcagacatttttttaacactttgcacctcaataaaagagagtggcaaaggacttgagcggtagcctcaaatcccttcgccggcgttatccggatcaggttcgacgggtattttctcagcacacgcgttccgcgcagcaccccgttgagcacggcgctagtgtaatgattttgttgccgggcagcaatgagggatggttgggggcgaggcccgcgcagaaacacgctgtacgttgctgatgatttactgttgcggagctgagcaaatctggcgcaggggcttgtgctggcctacaggatttcgggtaagcgtaggaaaagtgtattttcctgcgtattcgaaactacaaagccatgatgcaggtagaagtttttcgccgcgtcagagagggcatgaaccataattgcgcgcacacctatattctcagccacacgataaatgcgtaaaacggcatcatgaagtaaatccgcgcccagacctttgccgtggtaactcgcatcgactgcaagacgtgccaggataatgacaggaataggctcaggcatgtttcgtcgtaaactgccgggtgcaatggcgtgagtcacgctgccggtagccagggagtaaaatccaaccacctgtgacgtctttcccctgcataccacaaatgttctggccgcaccggtggagtgattttttaatccccggtgcctgatccattcatccagtactgcttccccacaatgaaactcagaaagaatatgtgaagagttaagcggttgcggagctgttacttttcccactgcggttttctcgccagcagtgtatccagcgccggattagcggtaaccggggcgtccagcatagtgataaattcggcatactgctcatcattgagattgtacattcgacgatcaaggatgacgttttcagcggcctgacaggctgtctcaagtataaaatcagtccgtgatttatgaagaatactggcggcagtatcgataagtgctctctgcgcttctttagccctgatattgagctggacatctgatttcatgttggctccgttgtatagcaagtgatatacaaattttactcttaacgtatagcaaacgctatacgctggtgcatattactcccgctgtactgatttaacatcgaaccacatgctcctggaattgccacctatagttaagagcaggttttaaacgtctttgcgaggcgcgccgcaaaccgtactgccaaatccgcttgccgttgatcgcgtctgacagtagcatcttcccgcacctgcaaaatcaggtgccgggattggtctcctgcatatcatacctgcgacatatgacgcgtaagcgtctttcttatgtcgtgcgtttggctacatctcaatggtgggctggacgggggcgccgcaaggcgcgccggtgtcggtatggccggtaagaccaactccgttcagtccgccacccgtaagattggtctcttcggtggtggaatatacattcacataccggaggctgcccttatggctacgaccctcaaccagactcacctgttacttaccgttccctttaccgcagacacggatttcaccgtgctggcggatcactgcgagcattttgctgaagcgctgatcgaaagcgacgatccggcgctgcgcctcgcgatgtgcgggcgtctgaacgcctgcctgatgctgctacaacccacactgaatgacgttattccaccgcatctgatcccgcaactcacggtggataccccgcctgcggaaccgccgtgtttcgaaccggaatctgatctgctgtgtgaatactgcctgaccttaacacgcctgttgaacagccagtcgctgccgtcggatatggagaaaaccctgaccgggctgctgtgtgaactggtatggtatttcaccgacataatgaaagcgccgcgctgggtgaaagggacagaagcgtagccagccgcaacatcttgccgggtgccacctgtaggcccggcaagcctgcgccgccgggcacgctgcatccttcccataccttcacgcccgccatttcctgctgccctttgtaagatctctaactaaaactgctgtctctgagcgttcaactatactgaatagtgccgttgttatttacgcaggatactgcgtgcagataattacctcatatttaccttaccgatgaccatctggagaatcacatgcaaaagagcaaaaccttgaaaggactgctggccgtatcggcagtggctgcgatgttcaccacgctcggcgtgcaagcccagacacaatccagcactgcaacgagtgacgccaccagccagaccgcatcgggcgctaagctcagttccggggacgaaaaagcggtgaaggatatggcgcaggccaatatcaatgaaatcgccgccgccaagattgcgctgagcaaagcgcaaagcagcgacgtgaaagccttcgcgcagaagatggtcgacgatcatggtgcagctctgaccaaagtccagacggtcgcccagcaaaaaggtgtaacgctgccgacggagccggacgctgagcataaggctatggcagcgaagctggaaaaagcgagcggtgatgactttgacaaaatgtatatggaaaacgccggtactaaagaccacaagatggtgctgacgaaactgcaaagcgatgcgaagatgatcaaagatccggatgtgaaggcgctggctgacgcacatacgccggtcgttgagcagcatctgaaatcagccgagcagatgactaagtaagctggtcgttcggtgggcacagggcccaccgacttttcctttatggctccggcggcgcaaaccacgccgatttaaagtcaaaccaccccagcgtattcatgcgcaggccgcgcatactgcgctgaccgttgatggtcagccagtgatggatcagcggcactatcgcgcggttcgccatcagctgctggcaccagttcgccagattcatttcgcctgcgcgccagtgcgcggcatcctgctgccagtcgcggggaatgcaccgctggagtagcggcacttcgtataaatgcgtgaacagcgaaaaatcgagcggcagcgtgaagttggcgctgttcagccagatatcgcttgtcacctcgccgctgtgccactcctcgtactccacctcctggatctccagccgcacatggtgctgtgccagcagggcgatcattgagcgggcgatgactttgtgctcctgatgttcccggtagtaggtaagggtgagggattccagaccggcgggtttttcgatctcgctaccgccgggtcgcgcgtgatgccagcgcggcagcaggccatatgccggaaaccagaagcgctgatagtgctcgtcgccgtgatacagcaggctagcaggggagagcacatggctgatccagtcccgcaccgccgcattgttgccctttggcgtacgggcatcgaacagcaggtagtagcagccctcttcaagacggctctcaatggctttttcgccctcgccggggccttccagcgtcaggccgccgctgggatcgtcgttcacttccggcagcacccagacgttcacctcatcaatcagcgcgcgaaagccaaagtagtcgtcaaaagcctggatcttcagctggctgctgttgttacgggtgacggcataggggccggtgccgaccggcaggctggcgaagttgctcatcgactcccattcatagggcaggatcatcgactgcacatggcccagcagccagggcaaccagctgtccggctcagagaggtgaatgtccagcgtccagggcgtgggagagacgatctgcgtgatgtgcgaatagagcggaaaggcgttgatacgctcaagggaggtgatgacgtcgcgcatctccagttcgcggccgtggtgaaaatgaatgccgggccgcagataaaatcgccagtgcagcggcgaaagctgttgccagtgatgggcgatatccgcttccagttccccgttttcctcatttacccgcgtcagggcgctgaagatctggcgggcgatatgggtttcagagcgtcttaacgccgtgccgggcagcaggttgcgcagcgggcggtaatagagcacacgcaaaatatggcggccctggcgaaaactgcgccccagatgcgacaccagcatctggcgcacggcggttttgtcgcccaccagctgcaccagctgatcgatacgatcctgctccagcagatcttctgcccgctgctgttgcaacgccagcccggtataaaggaaggtgagacgtgagcgcttaccccgtccggcttccgcttcccatgtcagccagccgcgcgcctgcatggtgttgagcagggtacgcatatggcggcgcgaacagctcagcagttccgccagttcgctcagcgtggtttccctggaagcgccgtcgcaacactgccacaggcggatgaattgttgttgcagacggcccgacgacataaaaggggaactcctgacgaaaactcatcaatttattaatccctatattaagccaatactgaacgtcgatggaagcggggagggctgctacagcattcgcttccaccatgtgtgactgagtattggtgcttatcgccacgccagcaggtatcatctgctggcttttttcattgtttgcgcgcgcaaaaggacgaattatgctgtggcttatgacgatgggcagacgtctgaacggggtctatgccgcgtttatgatcgttgcctttatgatggggatcgccggcgcattgcaggcgccgacgctcagtctgtttctcagccgtgaggtgggcgcgcaacccttctgggtgggcctgttttataccgtcaacgccatcgccgggatcctggtgagcctgtggctggcgaaacgatccgacagccggggcgatcgccgcaaactgatcatgctctgttgcgccatggccatcggcaatgcgcttttgtttgccttcaaccgccactatctgacgctcattacctgcggcgtgctgctggcctctatcgccaataccgccatgccgcagctgtttgcccttgcgcgggaatatgccgataactcggcgcgtgaagtggtgatgttcagctcggtgatgcgtgcgcagctgtcgctggcgtgggtgatcggcccgccgctggcctttatgatcgcgctgaattacggcttcaccgccatgttctgcatcgccgccgggatcttcgccatcagcctggcgctgattgcgctgatcctgccgtcggtggcgagggtggagcaggcggccgatgtgccggtcacccgcgtcagcggctggggcgacaaaaacgtgcgtctgctgtttatcgcctccacgctgatgtggacctgcaacaccatgtacatcatcgatatgccgctgtggatcagtgccgatctggggctgccggataagctggcggggatcctgatgggtacggcggcagggctggaaatcccggcgatgatcctcgcaggcttctacgttaagcgcttcggcaaacgccgcatgatgactctcgcggtggcggcgggcgtgctgttttatatcggcctgattttcttccacagccatgtggcgctgctcatcctgcaactgtttaacgccatttttattggcattgtcgccgggatcggcatgctgtggttccaggatctgatgccgggccgggcaggatcggcgaccacgctgttcaccaacagtatctccaccggcgtgattttagccggggtgatccagggcgcgctggcgcaaagttacggtcacggggtggtgtactgggtgattgccgggatttcgctggtcacgcttggcatcaccagccgggtgaaggacgtgtagatgcgtggtatgtgccgggtggcggctgcgccttacccggcctacaagatgtggtggtatgtgccggatggcggctgcgccttacccggcctacaaggtctggtggtatgtgccggatggcggctgcgctttatccggcctacaagatgtggtggtatgtgccggatggtggctacgccttacccggcctacgagtgacattgtaggccggataagcgaagcgccatccggcaacgggcttagcgcataaacgccggttgttttgcttcgtaagacgcgatggcgtcgtcgtgctgcaaggtcaggccgatactgtccagcccgttcagcatacagtggcggcggaaggcgtcgatgttaaagcggtaggttttatccccggccttcacctcctgcgcttccagatccacttcaaagcggatccccggattggacttcaccagttcaaacagttcatccacttcggcgtcgctcagcttcaccggcagcaactggttgttgaagctgttgccgtagaaaatgtcggcgaagctcggagcgatcaccactttgaaaccgtaatcggtcagcgcccagggggcgtgctcgcgggatgaaccgcagccaaagttttcccgcgccagcaaaatggacgcgcctttgtagatcgggaaattaagcacgaagtccggatccggctgctggcctttgtcgtccaggaaacgccagtcattaaacagatgcgcgccaaaaccggtacgggtcactttctgcaaaaactgcttcgggatgatcgcgtcggtatcgacgttggcggcatccagcggaaccaccaggccggtatgttgaataaatttctctgccatgatggtgtccttatttcaggttgcgaatatcagcgaagtgaccggtgacggcggcagccgctgccatggccgggctcagcaggtgcgtgcgtccgccgcggccctgacgtccttcaaagttacggttgctggtggaggcgcaacgctcgccggggttcaggcggtcattgttcattgccagacacatggagcagcccggcagacgccattcaaaaccggcttcgatgaaaatcttgtccagcccttccgcttccgcctgagctttcaccggcccggaacccggcaccaccagcgcctgtacgcccggcgcgactttgcgcccgcgggcgatgtcagccgccgcgcgcagatcttcaatacgcgagttggtgcaggagccgataaatactttatcgatagccacctcggtcagcggcacgcccggtttcaggcccatgtaggccagcgctttttccgcggaggcgcgttcgaccggatcggcaaaagaagccggatcgggaataatatcgttcaccgagatcacctggccggggttggtgccccaggtcacctgcggggcgatctcttcggcgcgcagcgtcaccacgctgtcaaactctgcatcttcgtcgcttttgagggtggaccagtacgccaccgcctcgtcaaaatcgtggtctttcggcgcgtgcagacggcctttcacatagttgaaggtggtttcatccggcgcgaccaggcccgctttcgcgcccatctcaatcgccatgttgcacagcgtcatgcggccttccatgctcagggcgcggatcgcgtcgccgcaaaactccaccacatagccggtaccgccggcgctgccggttttgccgatgatcgccagcacgatgtctttcgcggtgatccccggcgctgcctggccggtgacttcaatcttcatggttttcgcgcggccctgtttcagggtctgcgtcgccagcacgtgttccacttccgacgtgccgatgccgaacgccagcgcgccaaatgcgccgtgggtggcggtgtgggagtcgccgcagacgatggtcatgcccggcagggtgatgccctgttccggccccatcacgtgcacgatcccctgatacgggtggttcagatcgtaaagttcgacgccgaattcgttacagttcttgatcagctcctgcatctggatgcgcgccatttcgccggaggcgttgatgtctttggtctgcgtcgagacgttgtgatccatggtggcgaaggttttacccggctgacgtaccgggcgcttgtgggcgcgcaggccatcaaacgcctgcggcgaggtcacttcgtgcaccagatggcggtcgatatacagcaacggggtttcgtctggcgcttcatagacgacgtgcgcatcaaacaatttttcatacaagctcttagccatgatcacaccccttcggaaacataacgggcaataatgtcgcccatttcatcagtactgacggccgcgccgccgtgggccaggtcaccggtacgcacgccttcttccagcgcgcggttaatggcgacttcaatggccgtggcggcctcgttcgcgtccaggctgtagcgcagcagcagcgccagcgacaggatctgcgcgatcgggttggcgatatttttcccggcgatatccggcgcggagccgccggcgggttcgtacagaccaaagccctgctcgttcaggctggcggacggcagcatacccatggaaccggtgatcatcgcgcattcgtcagacaggatgtcgccgaacaggttggagcacagcagcacgtcaaactgcgacggatctttaatcagctgcatagtggcgttgtcgatatacatatgcgccagctcaacgtccgggtattcctgcgcgatttcgttcacgatttcgcgccacaggatcgacgactgtaatacgttcgctttatcgatggaggtcactttgtggcggcgtttacgcgccgattcaaaggcgatacgcgcgatgcgttcgatctcaaaacggtgatacacctcggtgtcgaacgctttttcgtgctgaccgctgccttcgcggcccttcggctgaccaaagtagataccgccggtcagttcccgcacgcacagaatgtcgaagccgttcgcggcgatatcggcacgcagcgggcaaaaggcttccagcccctggtacagcttcgccggacgcaggttgctgaacagcttaaagtgtttacgcagcggcagcagcgcgccgcgctcgggctgctgatcgggcggcagcttttcccatttcgggccgccgacggagccgaacagcaccgcatcggcctgttcgcagccttcaacggtggcctgcggcagcgggttgccgtggcggtcaatggcgataccacccacatcgtagtggctggtggaaatacgcatgtcaaaacggttacggatcgcgtccagtactttcagggcttgcgccatcacttccgggccaatgccgtcgcccggcaaaactgcaatatgataatttttagacattacacggtttcctgattgttttctttaatagctttgcgttgcagttctttttcgacttcgttagcacgccagatattgttcagcacgtgcaccatggctttggcggaggattccacgatatcggtggccagacccacgccatggaagcgacgcccgttatagttcgccacgatgtccacctggcccagcgcgtctttgccgtggcctttggcggttaactggtatttcaccagctcaatgttgtagtcggtgatgcggttgatcgcctggtatacggcgtcgaccgggccgttgccgttggcggcttcggctttcacgtcatcaccgcatgccagcttcacggaggcggtggcgatgtcgttagagcctgactgcacgctgaagtaatccagacggaaatgctccggctcttcctgctgcttattaatgaaggctaaggcttccagatcgtaatcaaagacctggccttttttatccgccagcttcaggaaggcgtcgtacaggttgtccaggttgtagtcgctttctttataacccatctcgtccatgcggtgtttcacagcggcgcggccagagcgggaggtcaggttcagctgcacctggttcagaccgatggattccggggtcatgatttcgtagttggagcggtttttcagtacgccgtcctggtgaataccggaggagtgggcgaaagcgccggtgccgacaatcgctttgttggccgggatcggcatgttgcagatctggctgaccatctggctggtgcgccagatttcctgatggttgatacgggtgtgcaccttcatgatgtcctggcgtactttgatcgccatgatcacttcttccagcgagcagttaccggcacgctcgccgataccgttcatcgcaccttcgacctgacgcgcgccggcgttaacggcggccatggcgttgccgacggccagccccagatcgtcatgggtatgcacagatataatggctttatcaatgttcggcacgcgctcatacaggccgctaatgatactggcgaattcgaacggcatggtgtagccgacggtatcaggaatattaatggttctggccccggcgttgatcgccgcttcgaccacgcgcgccaggtcttcaatcggcgtgcggcctgcgtcttcacaggagaactccacatcgtcggtatagttacgggcgcgtttgaccatgtagaccgcgcgctcaatcacttcatccagcgtactgcgcagtttggtggcgatgtgcatcggggaggtggcaataaaggtgtgaatacggaaggcttccgcgactttcagcgactccgccgccacatcaatatctttctccacacagcgcgctaaagcacagacgcggctgtttttaacctgacgggcgatggtctgcacggattcaaaatcgccaggggaggagacagggaacccgacttccatgacgtcaacacccatacgttccagcgccagcgcgatttgcagtttttctttcacgctcaggcttgcctgtaatgcctgttcaccgtcacgtaaggtcgtatcgaaaataatgacttgttgctggctcatggtttaggtccttttctgtctgagggcgctttgctacgagcataaaaaaacccgcgcaatagcgcgggttcgttattctaccgggagatgacttaattctgcgtgtcgcccaccagtccaccgcgcaaggaagatgcgtttagtagtagtagaccggcgaaacgaacgtggcgaatcatgtgtcatgctccagatgaatacaatatgcttctagtggtactggatacgtaatctgatgtcaacccccgatcccggaaatgcacttttttaagcgcgtcagccgtatggcgtgatgaggtaattgtgctgtatctgacagcaaaggcagtgacatcctttttcaaaaaatgacgcgcttgcattttgtgacaaatacacatgactgcttatttttgttcgcaagccgcaatgacgattttcctgtctgtatcgctatgattttccattacttgtttcagatactggttttgtctcaggaatatattgttaagtattgtacttatcatgttaattctctggtgctttattgttttgagttaagagaaactgaaatggcgattaaataaaagtgattatgtatattcatggtgtttatgtttttatttgcgtcaagttatacggtgaatgtgttgatcactaatccgccgcattgattaccaaatttaatcgctttactcatcaagagatctttatatattcctattttgtaaaaatcttcttttgcttgtttcatatgcatggtaaataatatttcacgaaattattactgcataagtaaagggaggttggcgtgacagtggagttcaatatgccagaagaaaacattaccaatattaatccatccgaagcgacgaaacccaagctgcgaatggtcgaccttaatttactgacggtatttgatgtggtgatgcaggagcaaaacatcacccgcgccgcgatgcatttacagatgtcgcaacccgccgtcagcaacgcggtcgcccgtctgaaagtgatgttcgatgatgagctgtttgtccgctatggccgcggcatccagcccactgcgcgtgctttccagctgtacggatctgttcgccaggcgttgcagcttattcagaatgaactgccgggagcgggtttcgagccgattaacagcgcacgggtatttaatttatgcgtctgtagtccgctggataattatctgacgtcggtgatttataatcgcgtcgaagaaatggcccccaatattcatttagtctttaaatcttccctcaatcacaatactgaacatcaactgcgttatcaggagattgagtttgtgattggttatgaagaatttcgtcgtccggagttttcctgtattcctctgtttaaagatgaaatggtgctggtggccagtaaaaaacatccgcgcctgacgggtccattacgggaaagcgatgtttataatgaagagcacgcggtggtggcgctggatcgttatgcctcttttagccaggcatggtatgacacgccggaaaaacagcgctgtatcgcttatcagggcatggcattaattagcgttctgaatgtcgtatcgcaaacgcatctggtcgctattgcgccgcgctggttagcggatgaatatgccgagaaattagaattacaaattctgccgttaccgctgaaattgaatagccgcacctgtttcctttcctggcacgaagcggcagggcgcgataagggccatcaatggatggaggagttgctggtttccgtctgccgtcgttaaatcttaacagacgcgcagcgtcttatttattctgttaatcatttataatgcaatattttctactaatgcatttttaacgtcagccttcgcgcgacgttaaaaatgcatgattacctgtctcattcccttttaccgtgacgattggtcatcgtctttacttatcatggtgtattcttctttctgagcttcgccgacctcttatttcttcttcctgatgactgtcgggctaaacctttgccaattgcctgcctgattttgagcggttaaggtgatcctcaaataacaaaataacgcctggaggcaaaccatggagatgttgtctggagccgagatggtcgtccgatcgcttatcgatcagggcgtaaagcaagtattcggttatcccggaggcgccgtccttgatatatatgacgccttacatacggtagggggcatcgatcatgtgctggtgcgccatgagcaggcggcggtgcatatggcagacgggctggcacgcgcgaccggtgaagtcggcgtcgtgctggtgacttcaggaccgggcgccaccaacgccattaccggtatcgctaccgcgtatatggactctattccgctggtagtgctctccggccaggtggcgacctcgctgattggctacgatgccttccaggagtgcgacatggtgggcatctcccgcccggtggtgaaacacagtttcctcgtcaaacagacagaagacattcccggcgtgctgaaaaaggccttctggctggcggcgagcggccgtcccggcccggtggtggtcgatttgccgaaagacattatgaacccggcgaacaaattcccttatgtatggcccgagtcggtcagcatgcgttcttataatccaaccacccagggtcataaaggccagatcaaacgcgcgctgcaaacgctgatcgcggcgaaaaatccggtggtttacgtcggcggtggagcggtgaacgcgggctgcgaagcacagctgcgcgagcttattgaaaaactcaatctgccggtggcgtcatcattaatggggctgggggcgtttccggccacgcaccgtcaggcgctcggcatgctcgggatgcacggcacttacgaagccaacatgacgatgcaccattccgatgtgatcttcgccgttggcgtgcgtttcgacgatcgcaccaccaataatctgatgaagtactgtccgaatgcctccgtgctgcatatcgacatcgatcccacgtccatttcaaaaaccgtggcggcggatgtgcctattgtcggcgatgcgcgtcaggtgctggagcagatgctggaactgctgggacaggaaacctccagtcagccgctggacgatatccgcgactggtggcttaagatcgaccagtggcgcgcccggcagtgtctgaaatatgacaccagcagtgaaagcattaagccgcaggcggtgatcgaaaccatctggcgcttaacccagggcgacgcctatgtgacttccgatgtcggtcagcatcagatgtttgccgcgctctattatccctttgataagccgcgtcgctggatcaactccggcggcctcggcaccatgggcttcggcctgcccgcggcgctgggcgtaaaaatggcgctgccggaggaaacggtgatctgcgtaaccggtgacggcagcatccagatgaacattcaggaactctccaccgcgttgcaatacgagctgccggtgctggtgctcaacctgaataacggttatctgggtatggtgaagcagtggcaggacatgatctattccggccgccactcccagtcctatatgaactccctgcctgattttgtgcgtctggcggaagcctacgggcatgtgggcatgcgcattacccatcctgccgaactggaaagtcagctggcagaagcccttgcgcaggtacgcaacaatcgtctggtgtttgtcgatgtctgcgtggatggcagtgaacacgtttatccgatgcatattcgcggcggcggcatggatgagatgtggttaagcaaaacggagaggacctgattatgcgccggatattatctgtgttactggaaaacgagtccggggccttgtcccgcgtgatcggtctgttttcccagcgcggctataacattgaaagcctgaccgtagcgcccactgacgatcccacgctttcgcgcatgaccattcagacggtgggcgatgcgaaagtgcttgagcagatcgaaaagcagctgcacaagctggtggacgtgctgcgcgtcaatgaactggggcagggggcgcacgttgagcgtgagatcatgctggtgaaaatccaggctagcggatacgggcgtgaagaagtgaagcgcaacgccgaaatcttccgtggacagatcatcgacgtgacgccgtcgatttacacggttcagcttgccggcaccagcgataagctggacgcttttctggcgacgatccgcgatgtcgccaaaattgtcgaagtggcacgctccggcgtggtgggtctgtcgcgcggcgataagatcatgcgttaagacgatagcgccagcctaaatcccggcccgacactccctgtcgggcttttttttgcgaattcaattgaaagcatgcgcgaaagcggttgccgcagtgactattctgcgtttagatgttatggaatttaacctatatcctcaaaaaggttatggagtatctttttttcttgagaggcaattgtgaaactggatgaaatcgcccggctagccggcgtctcacgtaccacagccagctatgtcatcaacggtaaagcaaagcagtatcgtgtcagcgataaaaccgttgaaaaagtcatggccgtggtccgtgagcataactaccatccgaatgcggtagcggccgggctgcgtgcaggacgtacgcgatcgattggactggttattcccgatctggagaacaccagttatacgcggattgcaaactatctggagcgccaggcgcggcaacgcggctatcagttactgattgcctgctcggaagatcagccggataacgaaatgcgctgcattgaacatctgctgcaacgacaggtggatgccattatcgtctccacctcgttaccgccagagcatccattttatcagcgctgggctaatgacgcgttccccatcgtcgccctcgatcgcgcgctggatcgtgagcacttcaccagcgtggtcggtgccgatcaggacgacgccgaaatgctggccgccgaattgcgcaccttccccgctgaaacggttctgtatttaggcgcgctgccggagctgtcggtaagcttcctgcgcgagcagggattccgcaccgcctggaaagacgatccgcgcgaagtgcagtatctctacgcgaacagttatgaacgggaagccgccgcgcagctattcgaaaagtggctggaaacacacccgatgccgcaggcgctgttcaccacctcttttgcgctgttgcagggcgtaatggacgtcacgctgcgacgcgatggcaagctgccatcgaatctggctattgccacctttggcgaccacgaactgctggacttcctgcaatgcccggtgctggccgtcgcgcagcgtcaccgtgatgtggcggagcgcgtgctggagatcgtcctggcaagcctcgatgaaccgcgcaaaccgaagccaggcctgagccgtatccggcgtaatctgtaccgccgcggcatacttaaccgtatttgagttccacccgaaaggcagccatagctgcctttttcttttctgctggttttaaattatcacgcctgcttaagaatcagattaatccttaaaaaatccaggggcgttaataacgaaggcgattaattatctgtggcctgtttttcatcattataagaagtaagcattcgtatattttgaattgttttgttacatcctcatctgatttgccgaattaaccatcacttttcccggcggcttttataaattgcgcttatggccgcgcagccgcggcatgcgcagctttaacgggcgctgtcatctgaatgcaatatggcttaaaatgccgcccgcgtcgcaaactgacactttatatttcagcactgctaagaagtgtgagggagcgctcatgaagaaattcggtttattttcttacaaatattcatgacgttaattcgcagtgcaggtagggcaaaatttccccggtgccgatcgctgtctgatgctggctggcttttaaatcgcttagcgtcagtgctggcttgacaagcttttcctccgctccgtaaactcctccagtggagatttgtgggataaagtggtgaaaagggtcatggtgaggtgaaactggcatgttccgtggagcaacattagttaatctcgacagtaaaggccggctcgctgtgcctacccgtcatcgggaatatctggtcgggcacgcttctggtcaactggtttgcaccatcgacatccaccacgcctgtctgctgctttatcctctcccggaatgggaaattattgagcaaaaattatcgcgtctgtcgagcatgaacccgctggagcgacgcgtgcagcgtttactgctgggccatgccagtgaatgtcagatggacagcgcgggccgtttactgataccgcccgttttacggcagcacgccggactaaacaaagaagtgatgctggtcgggcagtttaataaatttgaactgtgggatgaaacgacctggtatcaacaggtcagggaagatatcgacgctgagcaatctggtgctgaacagctttcagatcgattgcaggatttgtctctataacgatgatggataattttaaacatactacggttctgctggatgaagcggttaacggccttaacatccagccggacggcatttacattgacggcacctttggccgcggtggacattcacgtttgatcctctctcagttgggagtggaaggtcgcttactggctatcgatcgcgatccagaagccattgccattgctaataccattgatgatccccgcttttctattgtgcacgggcctttctcggcgctggcagattacgttgctgagcgcgggctgaccggcaaaatcaacggcattctcctcgatctgggcgtttcttctccgcaacttgacgatcctgagcgcggcttttcctttatgcgcgatggcccgctggatatgcgtatggatccaacgcgcggccagtctgccgccgaatggctgcaaaacgcggacgaagctgacatcgcctgggtgctgaaaaccttcggcgaagagcgtttcgcaaaacgtattgcgcgcgccattgtcgagcgtaatcgtctcgatccgatgacccgcaccaaagaactggcggaagtggtcgctgcggccacgccgattaaagataagttcaaacaccccgcgacccgtaccttccaggcggtgcgcatctgggttaacagtgaactggaagaaattgagctggcgctaaaaaactcgctcaacgtgctggccccgggaggtcggctttccatcatcagtttccactcccttgaagaccgcattgtgaagcgctttatgcgtgaaaacagccgtggtccgcaggttccggcgggattaccgatgacggaagcacaactcagcaagctgggtggccgttatctgcgggcattaggcaagttgatgccgggcgatgaagaagtggcagagaacccacgcgcccgtagttcagttctgcgcatcgcagagaggactaacgcatgatcagcagagtgacagagaccttcagcaaggttaaagaatcgttaggaagcaacgagcgccatgccttgcctggcgtgatcggcgacgatcttttgcgatttgggaaactgccactctgtctgttcatttgcatcattgccacagcggtgacggtggtcactaccgcgcaccacacgcgcttacttaccgcccagcgcgaacagctggtggtggagcgcgatgcgctggacatcgaatggcgcaacctgatccttgaagagaacgcgctcggcgatcacagccgggttgagcggatcgccaccgagaagctgcaaatgcagcatgtcgatccttcgcaagaaaatattgtcgtacaaaaataaggacttacccgacgcatgaaagcagcggcgaaggcgctaaaaccgaaacgccaggaagaacaggccaactttattagttggcgttttgcgttgctttgcggttgcattctactggcgctggcatttttgctgggtcgcgtagcatggttgcagatcatcaacccggatatgctggtgcggcagggcgacttacgctcgctgcgcgtgcaggaagtgtccacctcgcgcggtatgatcaccgatcgctctggccgcccgctggcggtaagcgtgccggtaaaagcgatctgggccgatccgaaagagctgcatgacgcaggcggcatttcgctggataaccgctggaaagccctttccgacgcgctgaatatgccgctggatcagcttgcggcgcgcgtcaatgccaacccgaaagggcgctttatctatctggcgcgccaggttaacccggatctgggcgattacatcaaaaaactcaaactgcccggcattcacttacgtgaagagtctcgccgttactacccttcaggcgaagttaccgctcacctcatcggctttaccaacgttgacagccagggcattgaaggcgtcgagaaaagctttgataaatggctcaccggtcagccgggggagcgcatcgtgcgtaaagaccgctacggtcgcgtgatcgaagacatctcttccaccgacagccaggcggcgcacaacctggcgctgagtattgacgagcgcctacaggcgctggtgtaccgagaactgaacaacgccgtcgcctttaacaaagcggaatcaggcagcgcggtgctggtggatgtgaacaccggcgaagtgctggcgatggcgaacagcccctcctataacccgaataacctcaccggcacgcagaaagatgtcatgcgtaaccgtaccatcaccgacgtcttcgaacccggttcgaccgtcaaacccatggtggtgatgacggcgctacagcgcggcgtggtgcgggaaaatacggtgctcaacaccgtgccttaccggatcaacggtcacgaaatcaaagacgtggcgcgttacagtgaattaaccctcaccggggtattgcagaagtcgagtaacgtcggtgtttcaaagctggcgttagcgatgccgtcctcagcgctggtagaaacttactcgcactttgggctgggaaaagcgaccaatttggggttggtcggagaacgcagtggcttatatcctcaaaaacaacggtggtctgacatagagagggccaccttctctttcggctacgggctaatggtaacgccgttacagttagcgcgagtctacgcaacgatcggcagctatggcgtttatcgcccgctgtcgatcaccaaagttgatcccccggtgccgggcgaacgtatcttcccggaatccattgtgcgtaccgtggtgcacatgatggaaagcgtggcgctgcctggcggcggcggcgtgaaagcggcgatcaaaggctatcgcattgccatcaaaaccggtacagcgaaaaaggtcggcccggacggaaaatacatcaataaatacattgcttacaccgcaggcgttgcgcccgccagtcagccgcgtttcgcgctggtggtggtgattaacgatccgcaggcgggtaaatattacggtggcgccgtttccgcgccggtgttcggtgccatcatgggcggcgttctgcgcaccatgaacatcgaaccggatgcgctggcgacgggcgagaaaagtgaatttgtgattaatcaaggcgaggcaacaggtggcagatcgtaatttgcgcgacctactcgctccgtgggtaccagcactgcctgcgagagcacttcgggaaatgacactcgacagccgcgtggcggcgtcgggcgatctctttgtggccgttgttggtcatcagacggacgggcgtcgttatatcccgcaggcgattgcccagggtgttgccgccatcatcgccgaagcgcagggtgaagccaccgacggtgagatccgcgagatgcacggcgtgccggtcatctacctgagccagcttaacgagcgcctctctgcgctggcgggccgtttttacaatgagccgtcagatcgtttacgcctgattggcgtgaccggcaccaatggcaaaaccaccaccacgcagcttattgcgcagtggggccagctgctcggcgaaaccagcgccgtgatgggcaccgtcggtaacggtttactgggcaacgttattcctactgaaaacaccaccggctccgccgttgatgtgcagcatgtgattgccggactggcagagcagggcgcgaccctggcggcaatggaagtctcttcccacggtctgatccagcaccgcgtggcggcgctcaaattccgcgccagtgtctttaccaatttaagccgcgatcaccttgattatcatggtgatatggaaaactacgaagcggcaaaatggctgctgttttccgcgcatcattatggcgaagccattgtgaacgccgatgatgaagtgggccgccgctggctggcaaaactgccggacgcggttgccgtttcgatggaagatcacatcaacccggactgccatggtcgctggttaaaagcgaccgacgtcaactatcacgacagcggcgcgaccatccgttttgactcctcctggggcgaaggcgagatcgagagccgtctgatgggcgcctttaacgtcagcaatttactgctggcgctggccaccctgctggcgctggatttcccgttaagcgatctgctgaaaaccgccgcgcgcctgcaaccggtttgcggccgtatggaagtgttcagcgcgccgggtaaaccgacggtggtggtggattacgcgcacacaccggatgcgctggaaaaagccttacaggcggcgcgcctgcactgcaccggcaaactatggtgcgtgtttggctgcggcggcgatcgcgataaaggtaaacgtccactcatgggggccattgccgaagagttcgccgacatcgccgtagtgaccgacgacaacccgcgtaccgaagagccgcgcgccattatcaacgatattctggccggtatgctggacgcaggccatgcccgcgtagtggaaggccgtgcggaagcagtgaccaacgccattatgcaggccaaagagaatgacgtggtgctgctggcgggcaaaggacatgaagattatcagattatcggcaccaaccgtctggattactcggatcgcgtgaccgccgctcgtctgctgggagtggtcgcatgatcagcgtgaatttaagccagcttgccgggatcctgaaaggcgaactgatcggttcggatctgactatcgatgcggtgacgaccgatacgcgtaaactgacgcccggctgcctgtttgtggccctgaaaggcgaacgtttcgacgctcacgattttgccgcgaccgctaaagaaggcggcgcgggcgcgctgctggtcagccgcaaagtggagtgcgatttaccgcagctgctggtgaaagacacccgtttagcctttggcgaactggcggcctgggtgcgtcagcaggtgccgacgcgcgtcgtggcgctgaccggttcctccggcaaaacctcggtcaaagagatgaccgcggcgatcctcagccagtgcggaaacacactttataccgccggcaacctaaataatgacatcggcgtgccgatgacattgctgcgtctgacgccggagcatgaatttgcggtgatcgaactgggtgccaaccaccagggcgaaatcgcctggaccgtgagtctgacccgcccggaagcggcgctggtgaacaacctcgcggcggcacatctggaaggtttcggatcgctggccggggtggcgaaggctaaaggtgagatcttcaccggcctgccgcaaaacggcatagcgatcatgaacgcggataataacgactggcttaactggcagagcgtgattggcgatcgtaaaacctggcgtttttccccgaatgccgccaacagcgattttaccgccaccaatatccatgtgacctcccacggcacggaattcaccctgcaaacgccgaccggcaatgtcgaggtgctgctgccgctgcctggccgtcataacatcgctaacgcgctggccgcgacggcattgtctatggcagtgggcgcaaccctggacgcggtgaaaaccgggctggcgcagctgaaagccgtaccggggcgtttgttcccgattgcgctgggggaaaaccagctgctgctggatgactcctataacgccaacgtcggttccatgaccgccgccgcgcaggtgctgtctgaaatgccgggctaccgcgtgatggtggtgggcgatatggcggaactgggcgcagaaagcgaagaatgtcatgcgcaggtcggcgccgccgcgaaagccgcaggcctggatcgggtactgagcgtaggcacagcaagtaaaacccttagcgacgccagcggtgtgggcgagcattttaacgataagtctgccgtcgtgacgcgtctgaaagcgctgatcgcagaacatcaaattatcaccattctggtgaaaggttcacgtagtgctgccatggaagaggtagtacacgcattacaggagaacgggacatgttagtgtggctggccgagcatctggtcaaatattattctggctttaacgtcttttcttatctgacgtttcgcgccattgtcagcctgctgaccgcgctgttcatctcgctgtggatgggcccgcgcatgattgcccgtctgcaaaaactcgcttttggccaggtcgtccgtaacgacggtccggaatcgcacttcagtaaacgcggtacgccaaccatgggcgggatcatgatcctgaccgcgattgtcatttccgtcctgctgtgggcctatccctccaacccttacgtctggtgcgtactggtggtgctggtcggctacggcatcatcggctttgtggatgattaccgcaaagtggtgcgtaaagacaccaaagggctgattgcccgctggaagtatttctggatgtcggtgatcgcgctgggcgtggcgttcgcgctctatctcgccggtaacgatacgccagccacgcagctggtagtgccgttctttaaggacgtgatgccgcagctggggctgttctacgtgctgctggcctacttcgtgattgtcggtaccggcaacgcggtcaacctgactgacggtctggatggccttgccattatgccgacggtgtttgtcgccgggggctttgcgctggtggcctgggcgtccggtaacatgaatttcgccaactatctgcacatcccttacctgcgtcatgcgggtgaactggtgatcgtctgtacggccatcgtcggcgcaggactcggtttcttatggttcaacacctatccggcgcaggtctttatgggcgacgtcggctcgctggcgctgggcggcgcgctgggcattatcgccgtgctgctgcgtcaggaattcctgctggtgatcatgggcggcgtctttgtggtggaaaccctgtcggtgatcctccaggtcggctcgtttaaactgcgcggccagcggatcttccgcatggcgccgatccatcaccattacgaactgaaaggctggccggagccgcgcgtgattgtgcgcttctggattatttcgctgatgctggtcctcatcggactggcaacgctgaaggtgcgttaatcatggcagattaccagggcaaaaaagtcgtcatcatcgggttaggtttaaccggcctgtcctgcgtggactttttccttgcgcgcggcgttaacccgcgggtaatggacacgcgcgttgcgccgccggggctggacaagctgccggaaacggtggagcgccatcttggtagtctgaatgacgactggctgctggccgccgatctgattgtcgccagtccgggtatggcgctggcgcatccgtccctcagcgccgccgccgatgaaggcgtggagattatcggcgacatcgaactgttttgccgtgaagcccaggcaccgatcgtcgccattaccggttcaaacggaaaaagcaccgtcaccaccctggtgggcgaaatggcgaaagctgcgggtatgaacgttggcgtcggcggcaatatcggcctgcctgcgctgatgctgctggacagcgcctgtgaactgtatgtactggaactgtcgagcttccagctggaaactaccaccagcctgcgcagcgtggcggcgacgatcctgaacgtcactgaagatcatatggatcgctatccgtttggcctccagcagtatcgtgcggcgaaattgcgcgtctatgaaaacgccaaagtctgcgtggtgaatgccgatgatgcgctgaccatgccggtgcgcggcgctgatgaacgctgcatcagcttcggcgtggatgtgggcgactatcacctgaaccgccagcagggggaaacctggctgcgcgtgaagggcgaaaaggtgctgaacgtaaaagagatgaagcttacggggcagcataactacaccaatgcgctggcggcgctggcgctggcggatgccgccggtataccgcgcgccagcagcctgaaagcgctaaccaccttcaccggtctcgcgcaccgtttccagctggcccttgagcataacggcgtgcgctggatcaacgactccaaagccaccaacgtcggcagcaccgaagcggcgctgaacggcctgcaggtggacggcaccttacatttactgctcggcggcgacggcaaatccgccgatttctcgccgctggcgcgttatctgaccggcgatcgtgttcgcctgtactgctttggccgcgacggcgctgaacttgccgcgctgcgtccggacattgccgtgcaaacggaaaccatggaacaggcgatgcgcctgatcgcgccgcaggtaaaagccggggacatggtgttgctgtcgcccgcctgcgccagtctcgatcagtttaagaatttcgaacaacggggcgatctctttacccgtctggcgagggagttaggctgatgcgtttatcgctaccgcgccttcgactgccgcgcctgccggggatgggtatccttggctgggctggctcggcacttcgtggctgggtcatgggatcccgtgagaaagacaccgacagtctgatcatgtatgaccgcatgctgctgtggctgacgcttggcctgggtgcggtaggttttatcatggtgacctcggcgtcgatgccggtcggccagcgcctgactaacgatccgttcttcttcgccaaacgtgacgcgctgtacctgttcctcgcgttttgtctggcggtgatcaccctgcgtctgccgatgaccttctggcagcgctacagctcggcgatgctgatcctcgccattatcatgctgctgctggttctggtggtgggcagctcgatcaacggggcatcgcgctggatcgatttagggctgatgcgtttccagcccgcggaatttaccaagctatcgctgttctgctatctggcgaactacctggtgcgtaaggttgatgaggtgcgaaataacctgcgcggcttcttaaaaccgatgggcgtgatcctcgtgctggcggtgttactgctggcgcagcctgacctcggtacggtggtggtgctctttgtcaccacgctggcgatgctgtttctggcgggcgccaagctgtggcagttcatcgccattatcggcatgggcatctccgcggtggtgctgctgatcctcgccgaaccctatcgtatccgccgcgtgacctctttctggcgtccgtgggacgatccgttcggcagcggttaccagcttacgcagtcgctgatggcgtttggtcgcggcgaattgtgggggcaggggctggggaattcggtacagaaactggaatatctgcccgaagcgcatactgactttatcttcgccattattggtgaggaactgggttatatcggtgtggtactggcgcttttgatggtattcttcgtcgctttccgcgccatgtccatcggtcgcaaggcgctggagatcgatcagcgtttttccggctttctggcctgttcgatcggcgtctggtttagcttccaggcgctggttaacgtcggtgcggcggcgggtatgctgccaaccaagggtctgacgctaccgctgatcagttacggtggttccagtctgttgattatgtcgacggcgatcatgctgctgttacgtattgattatgaaactcgtctggaaaaagcccaggcgtttacacgaggtgttcgatgagtgttcaggcgaagcgattaatggtgatggctggcggtaccggtggacacgtgttccccgggctggcggttgcgcatcatttaatggctgagggctggcaggttcgctggctgggcaccgccgaccgaatggaagcggatttagtgccgaaacacggcattgagatcgattttatccgtatttccggcctgcgcgggaaaggcgtgaaagccctgctgctggcgccgctgcgaattttcaacgcctggcgtcaggcgcgcgcaatcatgaagcgctttcgcccggacgtggtgctggggatgggcggttatgtgtcaggccctggtgggctggcggcgtggtcgctgggcattcccgtggtgctgcatgagcagaacggcatcgctggcctgaccaacaagtggctggcgaaaatcgccagaacggtgatgcaggcgtttcccggtgcctttgccaatgcagaggtggtcggcaacccggtgcgtactgatgtcctggcgctgccgctgccgcaggatcgccttgcaggccgtgaagggccggtgcgcgtgctggtggtgggcggctcccagggcgcgcgcattctgaaccagaccatgccgcaggtcgccgcgaagctcgctgaccgcgtcaccatctggcatcagagcggcaaaggcgcgcagcagaccgtcgaacaggcgtatgcggaaaacggtcaaccgcagcacaaagtgaccgaatttattgacgacatggccgccgcttacgcctgggccgatgtcgtggtctgccgttccggcgcgttgaccgtaagcgaaattgccgccgccggtttaccggcgttgtttgtacccttccagcacaaagatcggcagcagtactggaatgccctgccgcttgaaaaagcgagcgcggcaaagatcctcgaacagccgcagtttaccgtcgatgccgtggcagagacgctggcgggctgggatcgcagaacattattaatgatggcagagcgcgcacgtgccgccgccataccggatgcaaccgatcgggttgccagagcagtatgccttgcagcacaggcataaagatcgcgacgccttttgcgtcgcacgaatttttgaagtcgatggcgtttagagaatgaatacacaacaactggcgaaactgcgttctatcgtgcccgagatgcgtcgcgtccggcacattcactttgttggcattggcggtgccggtatgggcggtatcgctgaagtgctggccaacgaaggctatcagatcagcggctccgatctggcgcccaatccggtgacgcagcagttgtcttccctcggcgcgaccatttatttcaatcaccgtccggaaaacgtgctggatgccagcgtggtggtggtgtcgagcgccattaccgcggataacccggagatcgtcgccgctcatgaagcgcgcattccggtgatccgccgcgctgaaatgctggcggagttaatgcgttttcgtcacggtatcgccatcgccggtacgcacggtaaaaccaccaccacggcgatggtggccagtatttatgcggaagcagggctggatccgaccttcgttaacggcggtctggtgaaagcggcgggcgtgcatgcgcgtctgggtcacagccgttatctcatcgccgaggcggatgagagcgatgcctctttcctgcatttgcagccgatggtggcgattgtcaccaatatcgaagccgatcatatggatacctaccagggcgacttcgaaaatttaaagcagacgttcattaattttctgcacaacctgccgttttatggccgtgcggtgatgtgcgtggacgatggcgtgatccgtgaactgctgccgcgtgtgggacgtcagacgaccacttatggcttcagcgatgatgcggatgtacgcatcgaaaattatcgccagaccgggccgcagggtcactttacgctgctgcgtcaggacaagcctgcgctgcacgtaacgctgaacgcgccgggtcgccataacgcactgaacgcagcggcggcggtagcggtcgctacagaagagggtatcgacgatgcggcgatcctgcgcgcgctggaaagtttccagggcaccggccgtcgtttcgatttcctcggtgaattcccgttagaaacggtgaacgggaaagcaggcaccgcgatgctggttgatgattacggtcatcacccgacggaagtggacgccacgatcaaagcggcgcgcgcgggctggccggaaaaaaatctgatcatgatcttccagccgcaccgctatacccgtacccgcgatctgtatgacgatttcgccaacgtgctgacgcaggtggataccctgctgatgctggatgtgtattccgccggcgaaacgccgatcccgggcgcagacagccgttcgctttgccgtaccattcgtggtcgcggtaaaatcgacccgatccttgtgccggatcacgcgcaggtggcggcgatgctggcgccggtattaaccggcaacgatctgattctggtgcagggcgcaggcaatatcggcaaaattgcccgcagccttgctgaaagtaaactgaaaccgcaaacccaggaggaagaacatcatggctgagaaagttgccgtcctctttggcggaacctctgcggaacgtgacgtatcgctgaattccggcgcggcagtgctggccggtctgcgcgaagggggcgttgatgcccatcctgttgatccgcgcgataccgatgtcacgcagttaaaagcgctcggctatcagaaagtgtttattgccctgcacggtcgcgggggagaagatggcacgttacagggattgctggagctgatcgggctgccttataccggcagcggcgtgatggcgtcggcgatctccatggacaaactgcgcagcaaattgttgtggcagggcgcgggtttaccggtcgcgccctgggtggcgctaacccgtaaggccttcgaagcgggtcttgatgacgccgttacggcacagatttccgcgctgggcttaccgctgattgtgaagccgagccgcgagggctccagcgtgggcatgtcaaaagtcaccgaagccagtgcattacaggatgcattgacaatggcttttcaacatgatgaagatgttcttattgaaaaatggctcagtggcccggaatttacgctggccgtgctcggtgaagaaattttaccgtcaattcgcatccaacccgctggaaccttctatgattatgaggcgaagtatctctctgatgagacacaatatttctgtccttccggtttagaagcaggcgatgaatcgcatttacgcgatctggtgcaaaaagcatggaccgcgttaggctgtcagggctggggtcgcattgacgccatgcaggacagcgatggccagttttatctcctggaagcgaatacctcgccgggcatgaccagccatagtctggtgccgatggcggcgcgccaggcgggaatgagcttctcgcagctggttgtaagaattttggcattggcggactgatatgtcgcaggcggcactgaacacgcgcaaccagagtgaggaagacgttagctcctcacgacggaataatggaacgcgtctggcagggattattttcctgcttacggtagtgtgtaccgtgctggtgagcggctggatggtgctgggctggatggatgacgcgcaacgtttacccctttccagactggtagtcacgggcgaacggcattacacgcgtaatgatgatattcgtcagtccatactggcgctgggatcgcccggcacctttatgacgcaggacgtcaacatcattcagagccagatcgagcgcctgccgtggatcaaacaggcgagcgttcgtaagcaatggcccgatgaattgaagattcatctggttgaatatgtgcctatagcgcggtggaatgatcagcacatggtggatgccgacggcaattcgttcagcgtacctgcggatcgcgtcagtaaagagggattacctctgctgtacggtcccgaaggcagcgaaaacgaagttttgcagggctaccgtgatatgggtaaagagctggctaaggataagttcacgttgaaagaggcggccatgaccgcgcggcgctcctggcaattaacgttgaacaacgatattaagctcaatcttgggcggggcgatacgatgaaacgcctgtcccgctttgttgaactgtacccggtgcttttgcagcaggcgcagaccgatggcaaagagattagctacgttgacttgcgctatgactcaggcgcggcggtcggatggaaaccggctcccattgaggatcctaatcagcaacagaatcaggcacaggcagagcaacaatgatcaaggcgacggacagaaaactggtagttggactggagattggcaccgcgaaggtcgccgctttagtaggggaagttctgcccgacggtatgatcaatatcattggcgtgggcagctgcccgtcccgtggtatggataaaggtggggttaatgacctggagtccgtggttaaatgcgtacagcgcgccattgaccaggccgaattaatggcagactgccagatttcgtcagtgtatctggcgctttcaggtaaacacatcagctgccagaatgaaattggtatggtgccgatttcagaagaagaagtgacgcaggaagacgttgaaaacgtggtgcataccgccaaatccgtgcgtgtgcgcgatgagcatcgcgtcctgcatgtaattccgcaggagtacgccattgattaccaggaagggatcaagaacccggtgggtctgtcgggcgtgcgtatgcaggcaaaagtgcacttgatcacatgtcacaacgatatggcgaaaaacattgtcaaagccgttgaacgttgtggcctgaaagttgaccaactgatctttgccggactggcgtccagttattctgtgctgacagaagacgaacgtgagctgggtgtctgcgttgtagacgtcggcggtggtacaatggatattgccgtctataccggtggggcgttacgtcacacaaaagtgatcccttatgcggggaacgtcgtcaccagcgatatcgcctatgccttcggtacgccgccgagcgatgccgaagccatcaaagtgcgccatggctgcgcactcggctctatcgtcggtaaagacgagagcgtagaagtaccgagcgtgggcggtcgtccgccgcgcagcctccagcgtcagacgctggcggaagtgattgagccgcggtataccgaactgctcaatctggtaaacgaagagattttacagttgcaggagcagcttcgtcagcagggtgtgaaacatcatctggcggcggggattgtgttaacaggcggtgccgcgcagattgaaggcttagccgcctgcgcacagcgagtgttccatacgcaggtgcgtattggtgcgccgctcaatattaccggacttacggattacgcccaggagccgtattattccacggcggttgggttgcttcactacgggaaagagtcccatttgagtggtgaagcagaagtggaaaaacgtgtgtcagtcggctcgtggatcaaacgactcaacagctggctgcgaaaagagttttaatttttcagagaccggagaatattagcggtctcaggcgacaggcacaaaacggagagaaattatgtttgaacctatggaactgaccaacgacgcggtgattaaagtcatcggcgtcggtggtggcggcggtaacgccgtcgaacacatggtgcgcgaacgcatcgaaggtgtggaattcttcgcggtgaatactgacgctcaggcgttgcgtaaaactgcggtgggtcaaaccattcagattggcggcggcatcaccaaaggtctgggagcaggcgctaacccggaagtcggtcgcaatgcggcagaagaagatcgtgaagcactgcgtgcggcgctggatggcgcagacatggtgtttatcgcagcgggcatgggcggcggtaccggtaccggtgcagcgccagtcgtcgctgaagtagcaaaagatttgggtattctgaccgttgctgtcgtgaccaagcctttcaatttcgaaggcaagaagcgtatggcgtttgcggagcagggtatcactgagctgtccaagcatgtggattcgctgatcaccattcctaacgacaaactgctgaaagtgctggggcgcggtatctccctgctggatgcgtttggcgcggcgaatgacgtgttaaaaggcgcagtgcagggtatcgctgagctgatcacccgtccgggcctgatgaacgtcgactttgctgacgtgcgcaccgtaatgtccgaaatgggctatgcgatgatgggctccggcgtagccagcggtgaagaccgtgcggaagaagcggcagaaatggcgatctcctccccactgctggaagatatcgatctgtccggtgcgcgcggcgtgctggttaacatcaccgccggcttcgacctgcgtctggatgagttcgaaaccgtgggtaacaccattcgtgccttcgcttccgataacgcgaccgtggtaattggtacgtcgctggatccggaaatgaacgacgaactgcgcgtgactgtggtggcgaccggtatcggcatggacaaacgtccggaaattacgctggtgaccaacaagcagacgcagcaaccggccctggatcgttaccagcagcacggcatggcgccgttgacgcaggaacaaaaaccggcagcaaaagtggttaacgacaatacgccgcagaccaccaaagagccggattatctggatatcccggcatttttgcgtaaacaggctgattaagaattggctggaagttgggcatctccgctctttgtgctaaactggcccaccggttgtgtagtacaatctggttggataggtaattaggcgagataatacgatgatcaaacaaaggactcttaaacgtatcgttcaggcgactggcgtcggtttacataccggcaagaaagtcacactgacgctacgccctgcgccggcaaacaccggggtcatctatcgtcgcaccgacttgaatccaccggtagatttcccggctgatgccaaatctgtgcgtgataccatgctctgtacttgcctggtcaatgagcatgacgtacgaatttctaccgtagagcaccttaacgccgctctggcgggtctgggtatcgacaacatcatgattgaagtcgacgcgccagaaatcccgatcatggacggtagtgccgcgccgttcgtttacctgctacttgatgctggtatcgaagagcttaactgcgcgaagaaattcgttcgcattaaagagacagttcgcgttgaagatggcgataaatgggctgaatttaaaccgtacaatggtttctcgttggactttaccatcgacttcaaccatccggcgattgactccagcaaccagcgctatgcaatgaacttctctgccgatgcgttcatgcgtcagatcagccgtgcgcgtactttcggcttcatgcgtgatatcgaatatctgcaatcccgtggtttgtgcctgggcggtagtttcgattgtgccatcgtcgttgacgattatcgcgtactgaacgaagacggtctgcgttttgaagacgaattcgtacgtcacaaaatgctggatgcgattggcgacctgtttatgtgtggtcacaatatcatcggcgcatttaccgcgtacaaatccggtcacgcactgaacaacaaactgttgcaggcagtcctggcaaaacaggaagcctgggaatatgttacgttccaggacgaggcagaaatgccgctggcgttcaaagcaccgacaatggttctggcgtaacagtccataccattattaaaattcggctggcaaacctggcactctctccggtcaggggtgtcagccgtttttgtttttaaatcacggtattccgcttcttctgcccgcccgttactcctcttacggttttcagcatttttcctggtgcgttcggtgttttcttaagcagttttacctcttccacgccttcattactgctgtcctgtcacgccattagtggtaatatttgggcgcacaaaaacgaatacacaaataaacctgtgcaggtttgcatcattcaggtgaggtaagtgagcggattactgacgcgctggcgacaatttggcagacgctacttctggccgcatctcttgttagggatggtcgcggcgagtctcggcctccccacgctcaataacaacgctgacgccgcgcaacccgccagaaccgctgccagtaatcacgatcgcatcactccggttaacttcaccagccttgcgctgctggaagcaaaccgccgacccagttttaccgtggattactggcatcagcacgcgatccgcacggttatccgccatctctcttttgctatggcgccgcagacgctgtccgtcgcggaagcgccattgcctggcgaggcgcaccaccgcgcgctgctggatacgctcaatgccttactgacgctggagagaaaacctccggtcattgttcgtcagtacatcactgcctcatcgttctccccgacggcgtttaacgtctctgcctggctgagccaggtgcaggggatccgcgccggacctcaacgcctcagctgatcttttctggtgttttcctttttattagactccgcgaagcggggcgtttgagatttttattatgctaatcaaattattaacaaaagtttttggtagtcgtaacgaccgtaccctgcgccgtatgcgtaaagtggtgggtgtcattaacagcatggaaccggcgatggaaaagctcaccgacgatgagctgaaagcgaaaaccggtgaattccgtgcgcgtctggaaaagggcgaaaccgttgaaagcctgatcccggaagcctttgcggtggtgcgcgaagccagtaaacgcgtgttcggtatgcgtcactttgacgtacagctgctgggcggcatggtgctgaacgaacgctgcatcgccgagatgcgtaccggtgaaggtaaaactctgaccgcaaccctgcccgcttacctgaacgccctgagcggtaaaggcgtgcacgtggttaccgtcaacgactatctggcgcagcgtgacgccgaaaacaaccgtccactgtttgagttcctcggcctgacggtgggcatcaacctgcctaatatgcccgctccggcgaagcgcgaagcttatgccgctgacatcacctacggtaccaacaacgaatacggctttgactacctgcgcgataatatggccttcagccctgaagagcgagtgcagcgtaagcttcactacgcgctggtggatgaggtggactccatccttatcgatgaagcccgtacgccgctgatcatttccggcccggctgaagacagctctgaaatgtacatgcgcgtcaacaaaatcattcctaacctgatccgtcaggaaaaagaagactccgacaccttccagggtgaaggtcacttctcggtggacgaaaaatcccgccaggtgaacatcaccgagcgcggtctggtgctggtggaagagctgctggtcaaagaaggcattatggaagagggcgagtcactgtactctccggccaacatcatgctgatgcaccacgttaccgctgcgctgcgtgcgcacgtgctctttacccgtgacgttgactacatcgtgaaagacggcgaagtcatcatcgttgatgagcacaccgggcgtaccatgcagggccgtcgctggtctgatggtctgcaccaggcggttgaagccaaagaaggcgtgcaaatccagaacgagaaccagacgctggcgtccatcaccttccagaactatttccgcctgtatgaaaaactggccggtatgaccggtaccgcggacaccgaagccttcgaattcagctctatctataagctggatacggtggtggtgccgaccaaccgtccgatgatccgtaaagatatgccggatctggtctacatgaccgaagcggaaaaaattcaggccattatcgaagatattaaagagcgtaccgccaaaggccagccggtgctggtgggtactatctccattgagaaatcagaagtggtgtctcaggaactggaaaaagcgggtatcaagcacaacgtgctgaacgccaagttccacgccaacgaagcggccatcgtcgcacaggcgggttatccgtcagcggtgaccatcgccaccaacatggcgggtcgtggtacggatatcgtgctgggcggtagctggcaggcagagcttgctgaacttgaagatccaaccccggagcagatcgcgcagattaaagccgactggcaggcgcgtcacgatgccgtgctggcgtccggcggtctgcacatcatcggtaccgaacgtcacgaatcccgtcgtatcgataaccagctgcgtggccgttctggtcgtcagggcgatgcaggttcttcacgcttctacctgtcgatggaagatgcgctgatgcgtatttttgcctctgaccgtgtgtcgggcatgatgcgtaaactgggtatgaagccgggcgaagctatcgaacacccgtgggtgaccaaagctattgccaacgctcagcgtaaagtggaaagccgtaacttcgatattcgtaagcagctgctggaatatgatgatgtggcgaacgatcagcgtcgtgcgatttacacccagcgtaacgaactgctggacgtgtccgacgtaagcgaaaccatcaacagcatccgcgaagatgtcttcaaggcaaccatcgatgcgcacattccgccgcagtcgctggaagaaatgtgggacatccctggtctgcaggaacgtctgaaaaacgatttcgatctggaactgccgattgccgagtggctggataaagagccagagctgcacgaagaaaccctgcgcgagcgtattctgactcaggcggttgaagtctacaaacgcaaagaagagatcgtgggcgcggagatgatgcgccacttcgaaaaaggcgtgatgctgcaaacgctggattccctgtggaaagagcaccttgcggccatggattatctgcgtcagggtattcacctgcgcggttatgcgcagaaagatccgaagcaggaatacaagcgtgaatccttcgccatgttcgcggcgatgctcgaatccctgaagtacgaagtgatcagcaccctgagcaaggtgcaggtgcgcgaaccggaagaagtggaagagatggagcagcagcgtcgtcaggaagctgaacgtctggcgcagatgcaacagctcagccaccagaccgacgaagctgaagccgcagaagcgctggccgcacagaccggcgaacgcaaagtgggtcgtaacgatccctgcccgtgcggttccggtaagaaattcaaacagtgtcatggccgtctgaactgatcctgtcacgaccaccacaaaaggcgcagatatctgcgccttttttatggagcgaaatgaatgaaagtactgcatatttctgccggcatcatccgcaatgcgcagggtgaaatctttattacccagcgcgctgccgacgcgcatatggcaaacaaaaaagagtttcccggcggcaaaatcgaagcgggtgaaaccccggagcaggcgctggtgcgcgagctggaagaagaggtggggattgtcgtcaccagcgcgcagctgtacgagcggctggagtacagctacccggaactgcatattacgctgtggttctatctggtggaaagctgggaaggcgaaccctggggcagggaaggtcaaccgggcggctggatagcgcagcaggcgctgaatgcggacgatttcccgcccgcgaacgcgcctatcgtcacccggttacaccaggaactttagggcttctcttcgctccagtcgtcgctgtcattaagctcgccggagctcgggatgcgtttttcttctgcggcccactcgccgagatcgatcagctggcagcgtttagaacaaaacgggcgaaacgggctgacgtcgccccagacaacttttttcccgcaggtcgggcagtttacgatcataacttcagacatatcagttccttaacagcaggccagttcaaaatccagacgctcagggatcacgccattttcactgtccagcggcaggaagcgaatggcgaagcggcttttatggccggaaatttgcggatagagcgcatccgacagcgcaagttgcagacgcagtaaatcggcatcctcgccgttatcctggtaaaaaccatgcaggctggtctgcttacggaatggcgcggaattacgcactaattcgaggatcagggttaacgtctgggtcaggggctgcaggctgttaagccagacgctgacctgctcatcccgttgcgcctggggtaaatgcagccacaggtgcagcgtcggcaaatcaaagctacagcagccgccgggaatgctcagacgctggcgaaccaggccaatgagtttatcttcacgcaataactggccgatgcgcggggccgacatcagcgtcgtgctgcactgtctgagctgatcgctgagagcggcgatccgctcctgatccacgcccggcacttcgacccaggctttaagtttacgctgctggcgctccagctcttttaacaattctgtgcgtacttccccgcgttcgaacacatccagcaggtcgccgatattacggaaaaaatgcagcgcgtcggtggaatcagcgatgggtaaacggcatgacagctgctggaccaaaaattcaatgcgcaaccaggtgcgcattttttcattaagcggatgttcaaagaggacatgggtgtgcattacgctttttcctgtgaaacggcccgggcggcgtagctaaggtacgcggcatgcaggcgggcaacatccgatgccacggcatctggtgcgccattattgtcaataatatcgtcagcgatggccaggcgagcttcccgcgtcgcctgcgcggcgagtatatgttcggcatgttcgcgtgttacgccatcgcgctgcatggtgcgagagagttgtatttcaggcgagacgtccaccaccagcacccgatcggctttggtatgtaactggttttccaccagtaacggaacgacccataagacataaggggatgtcgcctgggcaatctggcgctgggtttcctgatgaattaaaggatgcagtaaggcgttaagccaggctttttctgccggggaggaaaaaatgcgttcgcgcagcacgcgacgatttaacgtcccgtctgcgttaatcaccgtatcgccgaagtgctcgccgatggcagccagcgcgggcgtacccggttccaccacctggcgggcgataacatcagcgtctactacgttaaccccacagcgggagaaagcgtttgcgacagtggttttgccactgccaatacccccggttaaggcgaccgtataccccataaaacaaaatcccaaaatggtcagccagacgacgaccggtcaatttatttgtttcgtaaatcaatcggttataattcgtacagaaaacggggcgtcagatgcggcgaaactgagccgttttccaggtaaatttataggattgtagcgtaaaaaaagagaatttcgcagtcttgcgcagacctatttagtgcgtatgatagcgtcactggagttgtgtgtttgacagtatgcttttatcgccattaaccccaggacccctacatgcgtatcgaagaagatttgaagttaggtttcaaagacgtccttatccgccctaaacgttctaccctcaaaagccgttccgacgttgaactgggacgcgaattcacctttaagcattcaggtatggcctggtcaggggtgccgattattgccgccaatatggataccgtcggcaccttcgcgatggcaaaagcactggcttcattcgacatcctgacggcagtacataaacactattccgtagccgactggcaggcgttcgttgcgcgtgaatccgacgcggtgttaaaacacgtgatggtgtccaccggcacttctgatgcggatttcgacaaaacccgccagatccttgccctgaatccggccctgaactttatttgcattgacgtggcaaatggttactccgaacacttctcgcagtttgtgaccaaagcgcgtgaagcctggcccaataaaaccatctgcgcgggcaacgtggtgaccggcgaaatgtgtgaagagctgatcctttgcggcgcggatattgtcaaagtaggcattggccccggctccgtgtgtaccacccgagtgaaaaccggcgttggctacccgcaactttccgcagtgatcgaatgtgccgatgcggcgcacggtctgggcgggcaaatcgtcagcgatggcggctgcaccgtaccgggcgatgtggcgaaagctttcggcggcggcgcagatttcgtgatgctcggcggtatgctggcgggacacgatgaaagcggcggtaccgttgttgaagaagacggtgacaaattcatgctgttctacggcatgagctctgaatccgccatgaatcgtcatgtcggcggcgtagcgggttaccgtgcagccgaaggtaaaaccgtgaagctgccgctgcgtggcccggttgaaaataccgcccgcgatatcctcggcggtctgcgttctgcctgcacctatgtgggcgcgtcccgtctgaaagagctgaccaaacgcaccaccttcatccgcgtggcggagcaagagaaccgcgtgttcaacagtctctgatgcctttgctggcgcggttcgctgcgccagccttatctatcccattccgctcattgcatcccccagatgaaacaccggcagatacatggccaccaccagcgtaccaataattaaccccgtcactatcagcatgatcggctccagcagtgcggccaggttatccgccagctgctgcgtcttttcgctgtgatagcgcgccagatcgccgagcatggtatccagcgcccccgacgcttcgccggttctgaccagctgtacgcagagcggggtaaattcaccgctgttcttcagcgcctgccagataggtgcgccatgggtgatctcatgatgcgcctgatgcagcaggtcacgccagtacgggcagggcagcgtattttccacactctccagcccctgcaaaaaggcgataccggcgttttgcgtaagcatcagcacggtaaaaatctggctgagcttttgcccgcgcaggagtgcgcccaccaccggacaccgcagcaacaggcgctgacgatagcgcaaccagcgcggctttttacgcagcttatacagggtaagaatcagcgcgataaacagtaccagcaccgccgcgccccactggtgtataccgtccgccagcgccatcacgccgcgcgttaacgccggcagcggcgcgttaaaggtgcggtagatggcggcgaactccggcagcaccaggtaaaccattgccagcacaatcagcaccgccagcgataagacgatcagcggatagcgcagtgcctttttaaccttcgccgccagcagccgctgcgccttttgccgggccgccagttcaaaacaacagctatcgagtttacccgtcagttcaccggtgtggatcagggcaacatacagcgggggaaaggcctgcggccactgctggatcgccgccgaaaacggcgtgccctgttccagctcctccgccaggtgttgcagcagcgcctgccactgggggcgcggatgctgtccggctaaaagccgtaacccatccggcaacgccagccccgcctgcaacagggtcgccagctggcggatcacctcctcgctgtgcgttccccgccaggcgcgcgcatgcaccggacagcgtttaagctgtaagaggtgcacagcgcggtgctgtaaggccatcgccacgctgacccggtcctcaccccacagcagcccctcgcgtggatgtcccgcctgatccagcccgcgccactgccacagggtattagtcggcatggggaatacccagtacgcgcagcagctcttcctgcgtggtcagtccgcgctcgacggccagacagccgctctcgaacagcgtggtcattccggcctgccgcgctttgcgatgaatgtcgctggccgtatcccccgcggcgatggcatgccgcagcggcttgtttaccggcagcacctcaaacagcgcgatcctgccgtaaaaaccgtgatagcactggtcgcagccagtggactgccatcgtggtaacgggcgcggccacagcgctggcgggatcagcgtgtcgctctggatttttgaccggcagtgcgggcagagtttgcgcaccagccgttgcgccaccaccagcgaaagcgccgaggcgagcatccatggcgcaacgcccatttgctggatgcgcgtcagggtttcgctggtggagttggtgtgcagcgtcgacagcaccagatgcccggtctgcgaggctttaatagcgatttccgccgtttcgccatcgcggatctcaccaaccatgacgatatccggatcctgacgcagcagcgcgcgcagtacgctctgaaagctcaggcccgcacgtggattgatttgcgtctgattaagtcccgccagcgggatttcaacaggatcttccacgctgcaaatattcacctcatcgctgttacgcgactgtaaggcgctgtagagcgtcaccgttttaccgctgccggtaggcccggtcaccagcagcaggccctggggtttgctgagcgcggtctgaaactgcgccagctgttccggcagcatgcccagttgcgtcagctccagcgtctgattgacctgatgcagcagacgcagaacaactttttcaccgtagcggcagggcagggtggcaatgcgaaacgaaatggctttaccgttgagtgttacggtaaactgcccgtcctgcggcaggcggcgctcggcaatgtcaagattgcccagtaccttaagacgcgccaccagggttttcgccatggctggcgccaccggcggcaaggtgtgcagtacgccgtccacccgcagacgaattcgaaaatcagcctcgcccggctcaaagtgaatatccgatgcccgcagcgtcagcgcctgttgcagggtatgatcgagaaacgccgttgtggtggcgctgtcctgcgtcacaacagatagctgcggcgcagagagacgctgccggtgtttttccatctcctctgccgtccagcactcaatgtcgatacgcttttgggtagcaaagcgcagcgcagccatcagatcgtcagacggctcgtttataaccgcgatagcgatgcgccgatcgttactctccagcagcagggcgttatgacgctgacataacgcgatcaactgttcctgtttcatttcgcctcctgttgaccgctgaagcgaaacacctcttcacaggcctgtttcagcgcgccatcgtcctgcaccgtgcacagccgatcccagcccgtcatgccattgctgttattccactgtggcgtgagggtaacgccaagcccggtcaggctttcctgtccggtaagcgccacgacgcctttcaccacgctcatggcggagacatagcgggtggtggtgggcgacggaatgccgttgctgcccgcatcgcagaccgccacgccgccatgatcgagggcgcacagttcaatggctgtccggtaggggatgaaggtttgcagcatgtccgtcagcgccgctttgcgcaggtagttctgataggcgggaatgctgatggcgctgaggatggaaataatgccgataaccaccattagctcaattaaggtaaatcctttttgcgtgtccataatgtgctccttgttgacctggagcgactctggcagtaacggcggggcggtgcgaggggataaaacgtatccgcgaaggcggcttcagaagattttacgcgtgttgcaatattcagcacgattattgcgagcggctacgaaaaattgcccgacgactcccgccgggcaacgcacgctatcagcgaaaacgcatcgacagatccagcgcctgcacatgcttggtcagcgcgcccacggaaatgtaatccacgccggtgtcggcaaattcgcggatcgtttctgcggtgacattgccggacacttccagccgcgcctggccgctggcgcgcttcaccgcttcgcgcatttggtcagtgtcgaagttgtcgagcatgatgatgtcggccccggctttcagcgcatcatccagctcatccagggtttccacttccacttccaccggcacgtcggggtgcagccagaaggctttttccactgcctgacggacgctgcccgcggcgataatgtggttctctttgatcaggaaggcatccgacagcccgaggcgatgattcgccccgccgccgcacagcacggcatatttcagcgcggtacgcagccccggcagggttttgcgcgtatccagcagctgcgttttggtgcccgccagcagcgcgacgtagcggctgaccacgctggcgacgccggagagcgtttgcacaaagttcagcgccgtacgctcgccggtcagcagcacgcgggacgggccgtcgagttcaaacagcgtttgattcgcggtgatggcatcgccatcggcgacatgccacgtcagggcgacatcatcgccagccagctgaataaagacttcttccacccagcgtttgccgcagaaaataccgtcttcgcgggtgatcaccacggcgtgtgcgcggtcgtctgcgggcaataattgggcggtaatatcattgttcgcatccacctctccaccgagatcttcctgcagcgcgcgcgccacagcggcaggaatgtcgaggttaatacgttctaaaagcgcgtcacgtcgatggtcggggttatagcggcgaggcggcatgataaactccaaaaagggtaacgaatcaaaagattgaaacatgctactctgaaccgtgtatcagcaccatatcttaggagatcctgcatgctgttaaacaagggctggttggtggatgctcgccatgtgccttcgccgcaccatgactgccgcccggacgatgagaccccctcgttactggttgtgcataatataagcctgccgcccggacaatttggcgggccgtggattgatgcgctgttcaccggtacgctggatccgcaagccgatcccttcttcgctgagattgcccatctgcgcgtgtcagcacattgcctgatccgtcgtgatggcgaaatcgtgcagtacgttcctttcgataaacgcgcctggcatgcgggtgtgtcttgttatgcgggccgccagcggtgcaatgatttttccatcggcatagagcttgagggaacggacaccacgccctacaccccggcgcaatatcagcagttagccgcggtgacgcaaacattgatcgggctttatccggcaattgctgacaatataaccgggcacagcgatatcgcacctgagcgtaaaaccgatcccggcccggcttttgactgggcgacatttcgtgctctggtcaccccctcgtcagataaggagatgacatgacgttgtttactatgctgttagttctgattgccgagcgcctgtttaaactcggcgagcactggcagcttgatcaccgccttgaagtgctgttccgccgcatccgccatttttcgatgttccatacgctgggtatgaccgcgctggcgatgctggcgacctttctcgtgttacgcgcgctttatggcctgttttacaacgtgccgctgctggtggtgtggatcctgctcgggctgttgtgtatcggcgcgggcaaagtacggctgcactaccatgcttatctgaaggccgcagcgcgggatgatgcccatgcgcgcggcgcaatggccagtgaactgacgatgatccacggcgtgccgccggactgcgatgagcgtgagtttttacgcgagctgcaaaatgcgctgttgtggattaacttccgcttttacctcgcgccgctgttctggtttatcgtcggcgggacatggggaccggtgacgctggtaggctatgcgtttttacgcgcctggcagtcgtggctggcacgttatatgacgccgccgcagcgccatcagtccgggattgatgccattctgcatgtgctggactggatcccggtacggctggtgggcgtggtgtatgcgctgattggtcacggtgaaaaggcgcttccggcctggtttgcgtcactttacgatcgtcatacgtcgcagtatcaggtgttgacacggctggcgcagtattcgctggcgcgtgagccgcatctggaccgcgttgaaacgccaaaagtggcggtttcaatggcgaagaaaacgtcctttgtggtggtggttgtggtggcgctgctgacgatttacgggacgctggtgtaatttttgagacgatgccgggtggcgctgtgcttacccggcctacaagatcctgcgcttacccggcctacatatcctgcgcttatccggcctacagatcctgcgcttacaagcatatgtaggcccggcaagcgaagcgccgccgggcaatcttcttaattgttatccgccggtggcaccccaaagtccggcatcccgtcctctttccagtggatcactttcagccgcgtatgacggttcggatcgtacagcggatcgccttcgatctcggtgtagttgcgcgcgtggtaaaccagcacgtcctggccgtccggcgtttgcgtaaagctgttgtgacccggcccgtactggcgattctcatagctggtcacaaagaccggctgcggggatttatgccagttttccggctgctgcgggtcggcgtcaatagcgatccacagcaggcccaggcagtaattttcatcggtggcgctggcggaatagctgataaataaccgatcgccatggaacagcaccgccgggccttcattgaccttaaagccccggcactcccagtcaaattcgggtttgcttaacatcaccggctgacccttaatcgtccagggattttccagctctgccaggtacaggtttgagttgccttcaatggccggatctttttgcgcccacaggtaccactgtttaccctgatgcttaaaggtagtggcatccaggcagaaagagtcgaactgtgttttgatctgccctttttccgtccagcgaccggtcagcggatcggtgtcggcgcactccagcacaaacatacggtgctggaacatattcagcgcatccagatcgtgggtgtgcgtggcggcaaaatagagataccacttgccgttaagatgatgcagctccggcgcccagataagctggctcatcgggccgctggcgggtttacgccagaccacgctggcaggcgcatcgcgcaatccttcgatagtggcggcgcggcggatctccagccgatcgtattccggcactgaggcgacaaaatagtaggcgttgtcgtggcgcagaataaagggatcggcgcgttgttcgataaagggattgggccacgggttcatcaggctttccttatggtttaaccggctgatgggaagcagtctcattcagctcgcgataattagtgcgacgtttctccagatcgctctggatctgtttcatggtttcacggtcgactttcaacaggcgtaccacgcccgcggtgatcaaatagcccacgcccggaatgacgctgaacagcagtacgataccgttaatggcgcttgcgctttgcgctttcgcacccgcgtcgtaaccataccaggagagcaggaagccgaccatcgccccggcaaccgccagacccactttcaggaagaacaggttgccggagaagctgatgccggtgatgcgtttaccggttttccactcgccgtagtcatccacgtccgccatcagcgaccagtgcagcggggaggggatttgatgaataacgttaagcaggaaatagagcatcacgataagcgtcgtcgcctgcggatccaggaagtaaaagccgccggagaaaatcgccagcacaatgttggtccagaagaagacctgcaatttacaccagcggtcggtcagcactttcgccagcatactgccaatcatcatgcccaccacgccgaggctgataaacagggtggcgaaatgggtgctttgtcccatgacccaggtgacgtagtacatggtggccgccatgcggatgaagcccgggcagacattgcacagggtgagcagcagaatgcgtacccactggtcgtttttccagacgtctttgaagtcttttttcagatcgtcattggtcgggacggcgggtttgacgcgctcgcgtaccgtcgcaaagcagtagaggaacatgcacatgccgataaacgccagcaccgtcatcgccatctggtagcctttggctttatcttcgccgccaaaccactccgccatcggcagcagcgtcagcgacaacagcagggtggcgatccccaccatcacaaaacggtaagactgacaggcgacgcgctcttttggatcgttggtgatcacgctgcccagcgagcagtaaggaatgttgatggcggtataggtcagcgacagcaggaagtaggtgacaaacgcatagataaccttgctgttatatgtccagtccggcgtggtaaacatcagcacgctgaacaccgcgtaaggcacggcgatccataacagccatggacgaaatcgcccatatttgctcttcgttctgtctgccagcgcgcccataatcgggtcggttacggcgtcaattacgcggatggaaagcagtaatacgcccaccagcgccggagccagaccaaatatgtccgtatagaaataattcacaaacaacatgatagcgccaaagataatattacatccggcgtctcccattccgtagccgatcttttctttgactgacagtttagcgttgtccatcgacaattctcccgttgagatatggagagaattattcgcacgctatgacttttttgcgtagcaggtttaagttaaagagatggacaaaatggctatgcaggggaaagtgtgaaccaggtaacaggggcgggtccccctcgcccgaaggagaggggggaaagcaacaagattaatgggcttttgcggttttgaggttcttctgtttgaagaagtaaccgacggcaaggatgagcatccacaccgggatcagccagacggagatcgccatgcccggggtcatcgccataatcaccagcactgccgccataaagagcaggcagatccagttacccagcggatagaacagggccgggaagcgggttttcacaccctgcaaatctttcgcgcggcggaacttcatgtgcgccaggcttatcatcgcccagttgatcaccagggccgaaaccaccagcgccatcagcaggccgaaggcttcgcccggtgccaggtagttgatcagcacgcacagcgcggtaaagagcgcagagatgaggatggtgcccaccggcacgccgcgtttatccactttcgccagcactttcggcgcgttgccctgttgcgccagaccgaacagcatacggctgttgcagtacacgcagctgttgtacaccgacagcgcggcggtcagcactacaatgttcagggcgttagccacgaaggtgtcgcccagctcatggaagatcaacacgaaggggctggtgtcggcggtcacgcgcgtccacggcagcagtgacagcagcaccgccagcgagcccacatagaagatcagaatgcggtagatcacctggttggtggctttcgggatgctgacctgcgggttatcggcttcggcggcggtaatgcccaccagctccagcccgccgaaggagaacatgatgatcgccatcatcatcaccagcccggtaaagccgttaggcaggaatccgccctgttcccagaggttgcgcacggtggcctgcgggccggcgctgtcgctgaacagcagccagccgccgaacaggatcatcgccacgaccgcgatcactttgataatggcaaaccagaactccatctcgccaaacacttttacgttggtgaggttgatagcgttgatcaccacgaagaacacggcggccgacgcccaggtcgggatctccggccaccagaattggatgtatttaccgacggcggtcagttccgccatggcgaccagtacgtacagcacccagtagttccagccggacgcgaagcccgcgaaaccgccccagtatttataggcaaaatggctgaacgaaccggctaccggctcttcaaccaccatctcgcccaactggcgcatgatcagaaaagcgataaaacctgcaatcgcatagccgagaataattcccggcccggcggactggatgactgacgcgctgcccagaaacaggccagtcccgatagctccacccagcgcaataagctgaatgtggcggtttttaagcccgcgcttcagcagttcaccgtgctgttgaccttccatcatgaaacctcgtgtgtggttattattagtacgctgttgtgtgcgtgtacggatgaaattccatttgttgtatttatatgtttacgaaaggtctttcttaaatatggcgctgagtctttcgtctgcatcagaatagtggtaagcgcatgcgaatgcacctgctttattaggggcgcatgacgactgaataaaaagaaaccaattgtaaatggtagccattcctcctcttcattaccccaaatgcataattccactccagaaatgggtatttactcgtttttcgtgcgactgaatcggttcactttaccggtcaggcgtttcacataagttaaatatgcctctttatgagtagcgggctcatttgtgcgaagttacatttctgaaacgttatttctgtaatgttgttaaaatgtgcgtggttccctgatttcaatcaaaacctgtatggacagaaggtgaatactttgttactttagcgtcaagaacatgaaattggtcagaccaattgactccggttaaatggcactccgggaaaacggcttaggacagggaacaatggcctacagtaaaatccgccaacctaaattatccgatgtgatagagcagcaactggagtttttgatccttgaagggacattgcgccccggtgaaaaacttcctccggaacgtgagctggctaaacagttcgacgtttcccgtccttcgctgcgcgaggcgatccaacgccttgaagccaagggcctgctactgcgtcgccagggcggtggtacctttgtccagagtaacctgtggcagagcttcagcgatccgctggtagagcttttgtccgatcaccccgaatcccagtttgacctccttgagacgcgccacgcgcttgaaggcattgccgcctattacgcggccttgcgtggcaccgacgacgatcgcgcgcgcatccgcgagctgcatcaggcgatcgagcgcgcgcaggaatccggggatctcgatgccgaagccgatgccgtcgtcctgtatcagattgccgtcaccgaagcggcgcacaatgtggttttgctgcatttgctacgctgcatggaaccaatgatggcgcagaacgttcgtcagaattttgaattgctgtatgcccgccgggaaatgctcccgctggtaagcaaccatcgctccagaatttttgaggcgattatcgccagagagccggagcaggcgcgtgaagcgtctcaccggcatctggcgtttattgaggaaatattgctggaccgcagccgtgagcagagccgtcgtgaacgctccatgcgccgcctacagcaaagaaaggattaagcgccataatttagagcgcggcaactaaacgcagaacctgtcttattgtgttttctgccgaaaatacaatgggacaggttccagattaatcaacgaaaattagatagataaggaaaaacccatgtcagatcgtttaatcaatgacgtggatccgatcgaaactcgcgactggcaacaggcgatcgaatcggtcatccgtgaagaaggtgttgagcgcgctcagtatctgattgaccagttactgtctcaggcccgcaaaggcggcgttaacgtggcagctggttcaaacgctcgcaactatgtaaatactattgccgttgaagatgagccggaatacccgggtaatctggagctggaacgtcgcattcgttctgctatccgctggaacgccatcatgaccgtgctgcgtgcgtctaaaaaagacctcgagctgggcggccacatggcgtctttccagtcttctgcgactgtgtatgaagtttgcttcaaccacttcttccgcgcacgcagcgagaaagacggtggcgatctggtgtacttccagggccacatctctccgggcgtttacgctcgcgcattcctggaaggtcgtctgactgaagagcagatgaacaacttccgtcaggaagttcacggcaatggcctgtcttcctacccgcacccgaaactgatgccggaattctggcagttcccgaccgtctctatgggtctgggtccgattggtgcgatctaccaggctaaattcctgaaatatctggaacaccgtggtctgaaagatacttcccagcaaaccgtttacgccttccttggcgacggcgagatggatgagccggaatccaaaggcgcgatcaccatcgcgacccgtgaaaaactggataacctggtcttcgttatcaactgtaacctgcaacgtctggacggcccggtaaccggtaacggcaaaatcatcaacgaactggaaggcatcttcgaaggcgctggctggaacgtaatcaaggtgatgtggggcggtcgttgggatgagctgctgcgtaaagacaccagcggtaaactgatccagctgatgaacgaaaccgttgacggcgactatcagaccttcaaatccaaaaacggcgcgtacgttcgtgagcacttcttcggtaaatacccggaaactgccgcgctggttgccgactggtctgacgatgagatctgggcactgaaccgtggtggccacgatccgaagaaagtctacgctgcattcaagaaagcgcaggaaaccaaaggcaaagcgactgttatcctggcccataccatcaaaggttacggcatgggcgacaccgctgaaggtaaaaacatcgcccaccaggtgaagaaaatgaacatggacggtgtacgttacatccgtgatcgtttcaatgtgccggtgaccgatgagcaggttgagaagctgtcctacattaccttcccggaaggttctgaagagcacacctacctgcacgcccagcgtcagaagctgaacggctacctgccgtctcgtcagccgaaattctctgagaagcttgagctgccgaccctggctgacttcaaccagctgctggaagagcagaacaaagagatctccaccactatcgccttcgtgcgtgccctgaacgtgatgctgaagaacaagtcgatcaaagatcgcctcgtaccgatcatcgccgacgaagcgcgtactttcggtatggaaggtctgttccgtcagattggtatttacagcccgaacggccagcagtataccccgcaggaccgtgagcaggttgcttactataaagaggacgagaaaggtcagatcctgcaggaaggtatcaacgagctgggcgcaggttcttcctggctggccgctgcgacctcttacagcaccaacgatctgccgatgatcccgttctacatctactactccatgttcggtttccagcgtatcggcgacctgtgctgggcagcaggcgatcagcaagctcgtggcttcctgattggcgggacttctggtcgtactacgcttaacggcgaaggtctgcagcacgaagatggtcacagccacattcagtcgctgaccatcccgaactgtatctcttacgatccggcttacgcctacgaagttgctgtcatcatgcatgacggtctgcatcgtatgtacggtgaagcgcaagagaacgtgtactactacatcaccacgctgaacgaaaactatcacatgccagcgatgccggaaggcgccgaggaagggatccgtaaaggtatctacaaactcgaaactgtcgaaggcgcgaaaggtaaagttcagctgctgggctccggttctatcctgcgtcacgtacgtgaagcagcgcagatcctggcgaaagactacggtatcggttctgacgtgttcagcgtgacctccttcaccgaactggcgcgcgatggccaggattgtgagcgctggaacatgctgcacccgaccgacgagccgcgcgtaccgtacgttgcacaggttctgagcgacgcaccggcagtggcatcaactgactatatgaaactgttcgctgagcagatccgtaacttcatcccggcaagcgattaccgcgtactgggtactgatggcttcggtcgctctgacagccgtgaaaacctgcgtcaccacttcgaagttgatgcttcttatgtggttgtggcagcactgggcgaactggctaaacgtggcgacatcgacaagaaagtagttgcagaagcaattaccaaattcaacatcgatgcagataaagttaacccgcgtctggcgtaagaggtaaaagaagaatggctatcgaaatcaatgtaccggacatcggggctgatgaagttgaaatcaccgagatcctggtcaaagtgggcgacaaagttgaagctgaacagtcgctgatcaccgtagaaggcgacaaagcttctatggaagtcccgtcacctcaggctggcgttgttaaagagatcaaagtctctgttggcgacaaaaccgagactggcaaactgatcatgattttcgattccgctgacggtgctgctgatgcagcacctgcgaaagcagaagagaagaaagaagcagcaccggcagcagcctctgcaccggctgcggcggctgccaaagacgtcaacgtaccggatatcggcggcgacgaagttgaagtcaccgagatcatggttaaagtcggcgacaaagtggctgctgagcagtcgctgatcaccgtggaaggcgacaaagcctccatggaagtcccggctccgttcgcgggcaccgtgaaagagatcaaaatcagcaccggtgacaaagtgtccaccggctccctgatcatggtcttcgaagtggaaggcgccgctccggctgccagcgacgcgaaaccgcaggttaaagaagaagcggcttctgctccggcagcagcggcgggcgcgaaagacgtcaacgtaccggacatcggcggtgacgaagttgaagtgaccgaagtgatggtgaaagtgggcgacaaagttgccgctgagcagtcactgatcaccgtggaaggcgacaaagcctccatggaagttccggcaccgttcgcgggcaccgtgaaagagatcaaaatcagcaccggcgacaaagtgtctaccggctccctgatcatggtcttcgaagtggaaggcgcagccccggctgcggctccggctgcggccaaacaggaagcagcaccagcaccggcggcgaaagcaccggccgccgctgcaccggcgaaagcggaaggcaaatctgagtttgctgaaaacgacgcttacgtccacgcgaccccgctgatccgccgcctggcgcgcgaattcggtgtgaacctggcgaaagtgaaaggtacaggtcgtaaaggccgtatcctgcgcgaagacgttcaggcttacgtgaaagacgcggttaaacgcgctgaagcggcacctgctgctgctaccggcggcggtctgccgggcatgctgccatggccgaaagtggacttcagcaagtttggtgaagtggaagaagttgaactgggccgtatccagaaaatctctggtgctaacctgagccgtaactgggtgatgatcccgcacgttacgcacttcgacaaaaccgacatcaccgatctggaagccttccgtaagcagcagaacgccgaagctgagaagcgcaaactggacgtgaaattcaccccggttgtcttcatcatgaaagccgttgccgcagcgctcgagcagatgcctcgcttcaacagctccctgtctgaagacgcgcagcgtctgacgctgaagaaatacatcaacatcggtgtggctgttgataccccgaatggcctggtggttccggtgttcaaagacgtgaacaagaagagcatcaccgagctgtcccgtgaactgaccgtgatctccaaaaaagcacgtgacggtaagctgacggctggcgaaatgcagggcggttgcttcaccatctccagcatcggtggcctgggtactacgcacttcgcgccgatcgttaacgcgccggaagtggctatcctcggtgtgtccaaatccgcgatggagccggtctggaatggtaaagagttcgtgccgcgtctgatgatgccgatctctctgtccttcgaccaccgcgtgatcgacggtgctgatggtgcgcgtttcatcactatcatcaataacatgctgtctgatattcgccgtctggtgatgtaaataagaaagccggcctgacggtcggcttttttctggtaatctcattatgttactggggttattgggacaaaggacaactcgtttaccgtttgttgtttcaaaattgttaacaattttgtactatgcgggcggatagaacgtcccggcgaagaagggcgatacgtcccctggactgccggaaatcaataagaggtcatgatgagtactgaaatcaaaactcaggtcgtggtacttggggcaggcccggcaggttactctgctgccttccgttgcgctgatttaggtctggaaaccgtcattgttgaacgttacaacaccctcggcggtgtttgtctgaacgtcggctgtatcccttctaaagcgctgctgcatgttgctaaagttatcgaagaagccaaagcgctggctgagcacggtatcgtcttcggcgaaccgaaaaccgatatcgacaagattcgtacctggaaagaaaaagtcatcacccaactgactggcggtctggccggtatggcgaaaggccgtaaagtaaaagtggtgaacggtctgggtaaattcaccggggctaacaccctggaagtggaaggcgaaaacggcaaaaccgtaatcaacttcgacaacgcgatcatcgcggcgggttcccgtccgatcgaactaccgttcattccgcatgaagatccgcgcgtatgggattccaccgacgctctggagctgaaagaagtacctaagcgcctgctggttatgggtggcggtatcattggtctggaaatgggcaccgtgtaccatgcgctgggttcagagatcgacgtggttgaaatgttcgaccaggtgatcccggcggctgacaaagatatcgttaaagtcttcaccaagcgtatcagcaagaaattcaacctgatgctggaaaccaaagtgactgccgttgaagctaaagaagacggtatttacgtttccatggaaggcaaaaaagcccctgctgaagcgcagcgttatgacgccgtgctggtggctatcggccgtgtgccgaacggtaaaaacctcgacgcaggcaaagctggcgtggaagtggacgaccgtggctttatccgtgtcgacaaacagctgcgtaccaacgtaccgcacatcttcgctatcggcgatatcgtcggtcagccgatgctggcgcacaaaggcgttcacgaaggtcacgttgccgctgaagttatcgccggcatgaagcactacttcgatccgaaagtgatcccgtccatcgcgtacaccgagccggaagttgcctgggttggtctgaccgagaaagaagcgaaagagaaaggcatcagctacgaaaccgccaccttcccgtgggctgcttctggccgtgctatcgcgtccgactgcgcagacggtatgaccaaactgattttcgacaaagagactcaccgtgtgatcggtggcgctattgtcggtactaacggcggcgagctgttgggcgaaatcggtctggctatcgaaatgggctgtgacgcggaagatctggcgctgactatccatgcgcacccgactctgcatgagtccgtgggcctggctgctgaagtgttcgaaggtagcatcaccgacctgccgaacccgaaagcgaaaaagaaataagcgtctgagtttgtgttgccgggtggcggcttcgccttacccggcctgcaaatttaaaagatgtaggcccggcaagcttgcgccgccgggcaaacaggaccggacattaaagcggcttaatagccgctttttttatgcccgcgttttaccttcagggctgcaccggttgccactgctcgtccggcgtaaactgcgttatccccgcaatctgctgcgccgtctgcgcgccgaaatcccgctgatatacccgatcctgaccgtcaaccacaaaggtggcgacgccggttttgccgtagtccagcggccacgccagcagcgcggcaggcgcatcattaccttgccccttacccgtcagcagccggaaacgatagccgtgataaccctcgccgggcgcggtcgggctgaacgccgggccaagcgggctgtgcgcttcccccggtgacaccggccagtagaggccatcttttttaccctcgctgctgataagcttctgcgcgtaatggtggttaagggcgaagtaatcccgctgcgcgtccaaataagcctggagcgcgttaatagctgacagctcattgcgcccgagggtacgggtgaggatttcgtcggcggcgcgtgcggtatcaaactgccagcccgcggcggttttcaccatcgggatggggagctgccactgactgcgcccgacactcaggtgcgccacgccgttctgctcatcaatctgatggcttatctgccagtcgcgcagaaaacgcgccacggcttgcgcatctgccccgtccggcggcaggatctgctgccagtcatcgccgagcagttgcgtcagcacgctgtcattttgatcctggatggcgctgactagcgtactggcggcctgctccggcgtgctgaacgcctgctgcgcctgacccatcaccggtaacagcagcagcaatccggcgataattttctgtagtttcatgatccctgcctgattaacgacggttaagttcacggcgttcggccgcatgttcacgtaacgagctgcgctgttcgcggttcagacgctggcggctctgttcgccgcgctgacgctgcgcctgccaggacggtgaacggctgtcattgccgctcaacgccgtggcgcgggaagcgctctggcgctgctgcagcttttcccgccgctgttgctgttgcggcgtcgggttatcgtggcgggctttgatggcatcgcggcgctgttgctgctgcgcggtgggattgtcccggcgggcctgtatcgcctcgcgtttctgctgcgtcgtggactgattgaactgagtttttgccgcctcgcgacgggcggtagtggtgggagtatcgtaaccgcgataattattgcgctgcgcgatctggtttaactgctttgctgccgtctgacgctgcgcatcgcgggagggcaggttattacggaagacgggattgtgctgccacaccacagtgtcatttctggtgaccagcctgccgccggaaatgcggttgaagttattgacgttgatattgatgttatcgccgttatggtcgtagccgcgatggtaatgatcgtcatcccagtcaatatcgctgaacagcgcataagtggtggcgacgccgagactgaaacctaagccccgcaccaggctgtcggtgaactgctggccgggaggcggcggcagatacaccggcggataggcgggcgtcggccagctgccgtacactacggtcgggttatagctcgggacatacaccacctccggatcggcgggttcgattttgatcaccgtcggggctggcgtactcaccacggtagtgctgccggacgcggattgcggcgcggtactgcttttcgccggtacggtgctgactttctgctgcggcgtggaggtgagcgcgcccgtctgctgcgccagcgcgcgcagcttctgcactgaatccattacctctttcggctgcgccagaaaggcatcgccgaggttttgcacccactgtgggttttcccccatcaatgccatcagcgacggaaaggccaccagcgatctgacgctcggatcccagggctggttaatcaccgcctggatcgccgcgtcgccctggagcgtgggattatcctgcgaccactgcgccgcctgcacgacgtttgcggggtaggtggcggccatcagcacctgcgagagcagcgcgtccgggtagagcgcgattggtgccacccactgatcgatttgcgccgtggtaaaggttgaggtggcgaccggcggggcgggcggcggggcgggcgtaaccggctgggcgacaacggcaggcggcggtgtttccggcgtcctgcttttgacatagagcacgcccgaggcggctaaaaccccggcgctgcacagcagcatcaggatctgaggtttgaatggcaacttcatgaggttctcccggtatccggtgggatacacgcgaataaaacacaggccagatggcggtaaatgcccgcgagtataaagcgctgattgtttattttttgattaaaacaggcatcgcaccgtgccccgtccataaccggacaacaagagtgttagtaaacattgcaaagcgtagggataagcccttttgcagagtcagccgtgggggataaaaaggtattttcgtctgccggagaagccctgtgaaagagaggtgtatcgcccgtaacgattcagctaatttttaatgttgcttttttgtaaacagattaacaccccctttaaatcctgctatgctgcccgtcgcggtaccgggcttttaccctacaaactgctgtctcacaggagcgtgaagaaactgccggccgcactatgacaatgagagcgaggagaaccgtcgtgctagaagaataccgtaagcacgtagctgaacgtgccgctgaagggattgcaccaaaacccttagatgccacgcaaatggctgcgctggtcgagctgctgaagtccccgccagtgggcgaagaagaattcctgttagatctgttagccaaccgtgtcccgccgggcgttgatgaagccgcctacgttaaagccggtttccttgcagccgtcgccaaaggcgaaaccgcctctccgctggtcactccggaaaaagccattgaactgctgggcaccatgcagggtggttacaacatccatccgctgattgacgcgctggacgatgctaagctggcgccgggtgccgccaaagcgctgtcccacacgctgctgatgttcgacaacttctacgacgtggaagagaaagccaaagcgggcaacgcttacgcacagcaggtgatgcactcctgggccgaggcagaatggttcctgagccgtccaccgctggctgaaaaaattaccgtcaccgtctttaaagtgaccggcgaaaccaacaccgacgatctctctccggcgccggatgcctggtcgcgcccggatattccgctgcacgcgctggcgatgctgaaaaacgcccgtgaaggcattgtgccggatcagccgggtagcgttggcccgatcaaacagatcgaagagctgaacaaaaaaggcttcccgctggcctacgtgggcgacgtggtcggtaccggttcatcccgtaaatccgccaccaactccgtactctggtttatgggcgacgacattccgaacgtgccgaacaagcgcggcggcggtctggtgctgggcggcaaaatcgcgccaatcttcttcaacaccatggaagatgccggcgcgctgccgattgaagtggacgtgaacgcgctgaacatgggcgacgtgattgacgtctacccgttcaaaggcgaagtgcgtaaccacgaaactggcgaactgctggcgaactttgaactgaaaaccgacgtgctgatcgacgaagtgcgcgccggtggccgcatcccgctgatcatcggccgtggcctgaccaccaaagcgcgtgaagcgctgggtctgccgcacagtgaagtcttccgtattgctaagccggttgcggcgagcgataaaggtttctcactggcgcagaaaatggtgggccgcgcctgtggcgtgaagggcgttcgccctggcgaatactgcgaaccgaaaatgacctcggtgggctcgcaggacaccaccgggccgatgacccgtgatgaactgaaagacctggcctgtctgggcttctctgccgatctggtgatgcagtccttctgccacaccgcggcctatccgaagccagtggacgtcaccacacaccacacgctgccggactttattatgaaccgcggcggcgtctcgctgcgtccgggcgacggcatcatccactcatggctgaaccgtatgctgctgccggataccgtgggtaccggcggtgactcccatacccgtttcccgattggcatctccttcccggcaggctctggtctggtggccttcgccgccgcgaccggcgtgatgccgctggatatgccggaatctgtgctggtgcgctttaaaggccagatgcagccgggtatcaccctgcgcgatctggtgcacgccatcccgctgtatgccattcgccagggtctgctgaccgttgagaagaaagggaagaaaaacatcttctctggtcgcatcctggaaatcgaagggctgccggagctgaaagtagagcaggcgtttgaactggcggatgcgtcagcggaacgttctgcggcgggctgtactatcaagcttgataaagcgccgattgaagaatacctgacctccaacatcgtcctgctgaagtggatgattgcggaaggctacggcgaccgccgtacgctggagcgtcgtattcagggcatggaaaaatggctggcggatccgcagctgatggaagccgatgctgacgccgaatacgcggcagtgatcgacatcgatctggcagatatcaaagagccgatcctgtgtgcaccgaacgatccggatgatgcgcgtctgctgtctgacgtggcgggtgagaagattgacgaagtgtttatcggttcgtgcatgaccaacatcggtcacttccgcgcggccggtaagctgctggacaaccataaaggccagctgccgacccgtctgtgggtcgcgccgccaacccgtatggatgccgcgcagctcaccgaagagggctactacagcgtgtttggtaagagtggcgcgcgcgttgagatcccgggctgttcactgtgcatgggtaaccaggcgcgtgtggcagacggctcaacggtagtgtccacttcgacgcgtaacttcccgaaccgtctgggcaccggcgcgaacgtgttcctggcgtccgcagagctggcggcggtctcttccctgctcggcaaactgccgacgccggaggagtaccagacctatatggcgcaggtcgataagaccgcggtagacacctatcgctatctgaacttcgacaaactcggtcagtacaccgaaaaagctgacgcggtgatcttccagactgccgtataagtgagcattctccactggtgagaaaacaagggtgagggcggtgatccgcgctcaccctttttatttctatatcctccgcccgtcccgctgtttttctttcccgctgctgcgataattaccccattgctggatcagaggaatgcatcatggattacgaatttttgcgtgatatcaccggcgtggtgaaggtacgcatgtcgatgggccacgaggtggtcggtcactggtttaatgaagaagtgaaagagaacctcgccctgcttgatgaagtggaagcggcggcgcggacagtgaaaggcagcgagcgtcagtggcagcgcgtcggacacgaatacaccctgtggatggacggcgaagagatcatcgtgcgcgccaaccagctggagttttccggcgacgagatggaggaggggatgaattactacgacgaggagagcctgtcgctgtgcggcgttgaggatttcctgcaggtggtaaaagcgtaccgcgaattcctgcagcagaaataatcatcacggagcgtccctgctccgtaaaccggtcttacacggcgggaatattgcggccgtaatagatttcgcgcatctctttccacagcgcttcggtgatcactttacgctcgtcggcggtgagatcttccgggcgggtgtggaacatatagtgtttcaggtcgaattctttcagcaacatcttggtgtggaagatattttcctgataaacgtttacatccaccatgtcatacagcgctttcatgtcatcggacaggaagttctgaatcgaattgatttcatgatcgataaagtgttttttacccgacacgtcgcgggtaaagccgcgcacgcgatagtcaacggtcacaatatcggactcaagctggtggattaaataattcagggctttcagcggtgaaatcaccccacaggtcgagacttcaatatccgcgcggaaggtgcacagtccgccctccggatggctttccgggtaggtgtgaacgcagatatggctcttgtcgaggtgagctaccacggtttccggcagcgggccaggatgttcagtgttgtcgatcagatgcggttcaacgggctcttcgctgacgaggatcgtcacgctggcgccctgcggctcataatcctgacgggcgatattcaggatattcgcgccaataatcgaacaggtttccgtcaggatctccgtcagtcgattggcgttatagagttcatcgatataggcgatataaccatcgcgctcttcagccgtattggcataacagatatcgtaaatacaaaaactcaggcttttggtcaggttattaaagccatgtagtttaagctttttcaatttttatcacccccttaggatcactgcgcaaacagtgcatcgtgcaaatattgtggtaacgcgaacgccgccgtgtgtactgccggattgtaataacgacacgtcaggtttgcgctgtggaaacgcgcctgaataatgccggtagaaagatgacgcagcgcgccgttgtccgtcgcccaggcgaaggtcatcacaccaccgtaataggtgggaatggcggcctgataaaaactcacatcgtcaaagtaatggctgagtttacggtgactgtcgatggcttcatcctgctgcaaaaagctcacgccgttttgcgcgacgaaaataccgccaggattcaggcaacgcttgcagccttcgtaaaatgccgaggtaaacagactttcgccaggcccgatgggatcggtgcagtcagagatgatcacatcaaaggtttgcgcggtctggttaacaaaattgacgccgtcgtcaatcaccagcgtaaagcgcggatcgtcataagccccggcattatgattcggcaaatactggcggcagaatgacacgacgcccgcgtcgatctccaccatggtgatggtttcgatactcttatgacggctcacttcgcgcagcatcgcgccgtcgccgccgccgatgatcagcacatgcttcgcatgaccgtgcgccagcagcggtacgtgggtcatcatttcatgataaatgaactcatcccgctcggtggtttgcaccacgccatccagcgccattacgcgcccgaatgcggcgttttcaaagataatcagatcctgatgatcggttttttcgtggtacagcaccttgtccacggcgaagtactgcccgaactggtcatgcagcgtttcgtgccacagtttgctatcagtcattgctcgctccttcgttaacacccatataaaacgggcgtaacatgatagctaactagtgacggggatgcacggctataaatccctgccccgcagaaggggcagaggaagggttatttcacgtaggcaagcaggctcagggaatcacgcgccagcgctttgcattttttatccgtggcgatgccaatgccgctgaggtcgcggtagctgtcttcccccagcgctttcatgtcaaagctctcgtagttgctcagatcccactgattctgctgggcgaaaaacaccagcgcgcgacggatctgaccgttcggtaaattctggtagccacagtcgtttttcaggaatacaaacaccgccgttaaatcggccatgtcttcggcttctgactcactgagtgcataactatttgctgatacagccagcaggctggcgaacgtaattgttctgaaaaacgtcttcattatttctaccggaacatcgaggaaatttaacgttagcatacttgggggcagggcgacgatctttattattagaggttcgcttgaccttaccgcaagggcagggtttatgctcaaaagctcgccaggctttaaaaagggaataaagatgcaacgtcgtgattttataaaatactccgctgcgctgggcgcgatgagcgcgctaccgggatggacgaaagcggcctttgccgccgcgccgcaagctctgccaatcccggcgctgctgacgccggacgcgcagagccgcattcagttacgggcgcaggctggcaccaccgccttcgccgggaaaaacgccgccacctggggctataacggtaatctgctaggtccggcgatcaaactgcgccagggtaaggcggtgaccattgagatcaacaaccggctggcggaagaaacgacggttcactggcatggcctggaagtgccgggcgaggtggatggcggaccgcagggcattatcaagcccggcggccagcgtaccgtcagctttacccccagccagcgcgcggccacctgctggttccatcctcatcagcacgcaaaaaccggtcatcaggtggcgatggggctggccgggctggtgctgatcgaagatgacgagagccgcatgctgcgtctgccgcaacagtggggtattgatgacgttccggtgatcgtacaggacaagcgttttaacgccgacgggcagatcgactatcagctggacatcatgagcgcggcggtcggctggtttggcgatacgctgctcgccaatggtgcgatctatccccggcatgccgccccgcgcggcttgctgcgcctgcgtctgctgaacggctgcaacgcccgctcgcttaacttcgccaccagcgacaagcgcccgctctatgtgattgccagcgatggcggcctgctggcggagccggtgaaagttgccgagctgccgatgctgccgggggagcgttttgaagtgctggtggagacccgcgacgggaaagacttcgacctgatcaccctgccggtcagccagatgggcatggcggttgcgcctttcgacaagccgcagccggtgctgcatattcagccgctgaccgttgtggcgtccggcgagctgcctgataccctcgcgaccatgccatcgctgccgccgctggatggcctgacgcagcgcacgctccagctgtcgatggatccaatgctcgacatgatgggaatgcaggcgctacagaaaaaatatggcgatcaggcgatgaccggcatggcggggcacatgagtcatggcgggatggatcacggcagtatggatcacggcggcatgaaccatggcgggcagggcgttgatttccgccatggcaatatgattaacggtaaagccttcgacatgaacaccccggcctttgccgcgaccaaagggcagtacgagcgctgggtgatttccggggagggggacatgatgctgcatccgttccatatccacggcacgcagttccgcattctgtcagagaacggcaagccgcccgcggcgcatcgcgcaggctggaaagatatcgtcaacgtatttggcgcgcgcagcgaagtgctggtgaagtttgactatgacgctccgaaagcgcaggcctatatggcgcactgtcatctgctcgagcatgaagatacggggatgatgcttgggtttacggtataaaaaaaccgggtggcggcgtcgcctcacccggtatgcttaacagggctgcccggaacgcttagcgaaccgggcattttttactattacttcgcctcatccggcagcgcataggccacaatatagtcgcccattttggtgccaaacgaaccgtgaccaccggcggaaatgactacatactgtttgccattcacttcataggtcatcggcgtcgcctgaccacccgccggcagacggccctgccacagtttctcaccgttgctcatgttgtaagcgcgcaggtagttatcggcggtagcggcgataaacagcacgttaccggcggtggaaatcggaccgcccagcatcggcatacccatattgaacggcaccgggatcggcatcgggaacggcaggctgtcctgcggcgtaccaatacgttttttccacactacgtcgttggttttcagatccagcgcggagatataaccccaggcaggctgtttacacggcagaccaaacggcgacaggaacgggttcagcgtcacgccatacggcacgccgtactgcggctggatcccggcttcggtaccgctgcctttcgcgtctttcggctgttccatcggattgcccggaccgcgcggcatcagtttggaaacaaacggcagcgccatcgggttagcaatcgccacctgacggttcggatcgacggaaataccgccccactcgaacataccgaggttacccgggaacaccagcgtgccctgctcggacggcggggtgaagatgccttcatagcgcagctgatggaacataacgcgacagaccagctggtcaaacatggtcgcgccccacatatccgcaccggtcagatctttcttcggacggaagctcagctcagagaacggctgggttttggtaacgtaatcgcctttcgccgcgccctgcggaaccggtttttccggtgccgggacaaccggctcgccattacgacgatccagcacgaagatgttaccggttttcgccggcgcgtagatcaccggtacggttttaccgttaacggtaatatccgccagcgtcggctgggccggtaaatccatatcccacagatcgtggtgaacggtctgatagctccaggccagtttaccggtggtggcgttcagcgccagcacggaactggcataacgctcctgctccggcgtacggttgccgccccagatgtccggggtgctcacgcccatcggcagatagaccagatccagcttggcgtcataggccgccggggcccaggagttcggcgagttaaaggtgaagctatgttcgtcagacgggatagcgttcggatctttcgcgcccggatcgaaggcccacagcagtttaccggtgttcacatcaaaaccacggatcacgccggacgtttcgcgggtggagaagttatcggtgacggaaccggcaatcacgatagttttatcggtaatgatcggcggcgaagtcggttcgtacagacccggcgtggtatccggcatgttggtttgcaggttcagaatacctttgttggcaaaggtttcgcacagcttaccgttatcggcgttgatggcgaacagacggccatcgttcaccggtaacatgatgcggcgcggacagtctgcgatcacttccgggctggcattgtcggcgcgcgcttcgtggtaagaaacaccacggcaggtaacgtgctggaacgaggtattagtattcagctgcggatcaaagtgccacttctctttaccggtcgctgcgtccagcgcaaacagacgctggtgcgcggtgcagagataaagcatgttgccgactttaatcggcgtcacttcgttggtcaattcacccggatcgttaggctgtttcagatcgccggtgcggaacacccaggcttctttcagatccttaacgttatcgacgttgatctgcttcagcggggagtaacgctggccttcctgattacggccataggctggccagtcggcgtcggccacctgggaaatcggctctgccggcgtggcgtcggcgctcagggtgccgttcacttcctgcggatcgttaaagcctgcccaggtcagcatcgcgccgctaaccagcagcgccacaaccagcgccgctactgcgccgcgggaaggcaccagcagacgacgccagacgaacggcaggatcagccagataccgaagaagaccagaatatcgctgcgtggggttaaggcccagaagtcaaagccgacttcccatacgccccaaatcatcgtacccagtaacagcgcggcgtagacccacagcgctgagcgcttgctgcgccacagcagccaggtgacggcgagcatcaccagcccggcgacagggtagtaccaggagccgccaatcgcgaccagccaggcgcccccgataagcaggtatagtccgcagaaagcggcgaacagcgcggtgatcgtcacgagtgtgcgtgacggatgcggtttattttctgccataaaagacactcatctcattttgttaatattttggaagcaattaattataggatttaacaagtgtgacagtcatcacaattctggcttttattatctcgtcccccggccgggggcatttactggtatactgacgcgcttatgaattgatgccggacgatacgctatccgcattgagtgattgttttttaaatcatacggttagagaaatgaaacatactgttgaagtgatgatcccggaagccgagatcaaagcgcgcattaccgaactgggtcgtcaaatcactgagcactataaggacagcggcagcgagatggtgctggtgggcctgttacgcggctcgtttatgtttatggcggatctgtgtcgtgaagtgcaggtgcctcatgaagtcgattttatgaccgcctccagctacggcagcggcatgtccaccacgcgcgacgtaaaaattctcaaagacctggatgaagatatccgcggtaaagacgtgctgatcgtcgaagacattatcgactccggcaacacgctgtcgaaagtgcgcgagatcctgagcctgcgcgagccaaaatccctggcgatttgtaccctgctggataaaccgtcccgccgtgaagtgacggtgccggtggaatttgtcggtttctcgatcccggatgagttcgtggtgggttacggcattgattacgcccagcgctatcgtcatctgccgtacatcggcaaagtggtgatgcaggacgagtaagcgtaaaaaagcccggtggcgctacgcttaccgggcctacatgtcagttcgtcgttacgtaggccgggtaaggcgaagccgccacccggcataaaaacataacgaatcttatttgtgattaatgtgcttctggctaatgttggacagcccctggcggtaacgcgattccagcgtgtcgcggttggtggcggttacttccagatcgcgcagcagaccgtcgtgaataccgtacgcccagccgtgaatggtcacgttctggccgcgcttccacgctgactgcatgatggttgagtggcccaggttatacacctgctccatcacgttcagctcacacagggtatccagacgacgctcttccggcatttcgttaagcagtgcgctatgtttaaaccagatgtcacggatgtgcagcagccagttgttgatcaggcccagttccgggttttccaccgccgcctgcacaccgccgcagccgtagtgaccgcagatgatgatgtgctcaacttccagcacatccaccgcgtactggacgaccgacaggcagttcagatcggtgtggatcaccaggttggcaacgtttcggtgaacaaataactcaccgggttcaagaccggtcaggcgctcagccggaacgcggctgtctgaacagccaatccataaaaagcgcggtttctgtgcctgtgctaatgtctcaaaaaatcccggatcctcttcgaccagcatttttgaccatagtgcattgttactaatgagtgtatctatgtctttcattgaggttaacgacctgtaaccaagtaatagcgttgagctaatataggtcaactccatttttttttaaaccacacatagagtgtaagaaaaaaggtaagaaagcagtcatgaccattgcactggagcttgagcagcttaaaaaaacctacccgggcggcgttcaggcgctgcggggtattgatttacaagtagaagcaggggatttctatgcgctactcgggccaaacggcgccggtaagtcaaccaccatcggcattatcagttcgctggtaaataaatcttccggacgggtcagcgtctttggttacgaccttgaaaaagatgtcgtcaacgccaaacgccagctcggtctggtgccgcaggagttcaactttaacccgtttgaaaccgtgcagcagattgtggtgaaccaggccggttactatggcgttgagcgtgccgaagcggtagcgcgcagcgaaaaatacttaaagcagctggatttgtgggaaaaacgcggcgaacgtgcgcgtatgctctccggcggcatgaagcgtcgtctgatgattgcccgcgccctgatgcatgaacctaaactgctaatccttgacgagccgaccgcgggcgttgacatcgaactgcgtcgctccatgtggggctttctgaaggatctgaatgacaaaggcaccaccatcattctgaccacccactatctggaagaagcggagatgctgtgccgtaatatcggcattattcagcacgggcaactggtggaaaacacctccatgaaatccctgctggcgaagctcaaatccgaaacctttattctcgatctggcgacgaaaagcccgttgccgaagctggaaggctatcagtatcgtctggtggacacctcgacgctggaggtcgaagtgctgcgcgagcagggcatcaatagcgtgttcagccagctgagcgcgcagggtattcaggtattaagtatgcgtaacaaagcgaaccgtcttgaagagctgtttgtcacgctggtaaacgaaaaaacaggagaccaggcatgatgcagctttattgggtcgcgctgaaaagcatctggcataaagaaattcagcgttttatgcgtatctggatccagacgctggtgccgccggtcatcaccatgacgctctatttcatcatcttcggtaacctgatcggctcgcgcattggcgaaatgcacggctttacctacatgcagtttatcgtgccgggtctaatcatgatggcggtgatcaccaatgcttacgccaacgtcgcctcgtcgttcttcagcgccaagttccagcgcaatattgaagaactgctggtcgcgccggtgccgacgcatgtgattattgtcggctatgtgggcggcggcgtggcgcgtgggctgtgcgtcggcgtgctggtgacggcgatttcgctgttcttcgtgcccttccaggtgcactcctggctgttcgtcggcctgacgctgctgctgacggcggtgctgttctcgctcgccggactgcttaacgccgtattcgccaagacctttgatgacatcagcctgatcccgacctttgtgctgacgccgctgacctaccttggcggggtgttctactccctgacgctgctgccgccgttctggcaggcgctgtcgcacttaaacccgatcgtctacatgatcagcggtttccgcttcggtttcctcggcatcagtgatgtgccgctcatcactaccattgccgtgctggtggtgtttatcgtggcgttttatgccttgtgctggtatctgatacagcgcgggcgcggtctgcgcagctaaccggttccccctctcttaacggagagggggcgctgaaatccattggtattacgaatgcttttgttacaatgcgcgcagaatttcctcaccacagttaagccatgctgatccgtttcgcttttactctgctgattctgctctccggcagcgcttccgccagcctgttgggccagccgaccgccaccgaacgttatatgcaaaccaccgaagatgccgccgtctgggcgcaggtgggcaatgaagtcattaccgtcgggcatctgaatgccggacagatcatcgccgtagcgcccacagccgccgactattacgaattccgcttcgggtttggcactggctttattgataaacagcatctggaagcggtgcagggaaaacagcgggtcgaggacagccttggcgatctgaacaagccgctcagcaatcagaacctgatcacctggaaaccgacgccggtctataacggccccaacaccggcagcgcgccctttggcatgctggtggaaaacctgcgctatccggtaatcggcaagctgaaagacggtctgaaccagacctggtatcagatccgcattggcaaccggctggcgtacgtcagcgcgctggacgcccagcaggatgaagggctgccgatcctgacctatcaccacattctgcgtgacgaggaaaatacccgtttccggcatacctccaccactacgtccgttcgcgccttcagtaaccagatgacgtggttgcgcgatcagggatacaccacgctgaccatgtctcagctggaaggctacgtgcacaaccggatgaacctgccggcgcgggcggtggtgatcacctttgacgacggcctcaagtcggtgagccgctatgcgtacccgatccttaagcagtacggttttaaagccacctcctttaccatcacctcgcgcatcaagcgtaagccagaaaagtgggatccgaaatcgctacagtttatgagcatttcagaaatgcagcagatccgcgatgtgtttgatttccagtcgcacacgcattttctgcaccgggtggataatagccgccatcccattttactgagccgcagctaccacgtggtattgttcgattttgagcgctcccgccgcgcgctggcgcagtttaatccccatgccctgtatctgtcctacccgtttggcggctatgacagcaaggcggtgaaagcggcccaggacgcgggctttcatctggcggtgacgacggtgaagggaaaggtaaaaccgggggataatccgttcttattaaaacgactctatattctaagaacggatcctctggagaccatggcgcggttaattgttaaccggccacagggttaactcaggcaacctgcaccggcacggctttcgcggtgcgtttcatctcgttgtcgccgtcaaaataggccactttcggctgccagctgcgcgcctgctcatcaggcatggtgacgtagctggcgatgatcagaatgtcgcccacatccgcgcagtgcgccgcagcgccattcacggaaatgatgcgtgaaccgcgctcaccggcaatcgcataggtggaaaagcgcttaccgttagtcacgttgtaaatatcaatggcttcgtattccagaataccagccgcctcaaggaaatcctggtcgatggcgcaggagccttcgtaatgcaggtcagcctgcgtcactttgacgcggtggagcttgccttgcagcatagtgcggatcataaagttaaccttcgttgctgtgtttgatagggggttttacctgcactagcgaggtaattccacgactttattatcgatcaggcgggcctgaccaagccaggcggccatcaggatcaccgcacgtttactggcgggggaaacctccagcagcgtatcggcatcccggatctgaatatcatcggcgcgaaaaccgctgttattcagctcctgctccgccacggcaacgatctcatggatgtcgttatcgcccgcgagcagtttttccgccatcgcgttcatcaccttgctcagacccggcgcgattttgcgctgatcgctggtgagatagccgttgcgggaactcagcgcgagtccatctttcgcgcgtaccgtcggcacgccgatgatctcaatgtcataacccatgtcagcgaccattttgcggatcaccgccagctgctgataatccttttccccgaagcaggcgacatccggctgcaccaggttaaagagtttgctgacgatagtggcaacgccacggaaatgccccggacggctcgcgccttccagcatcgccgacaggcccggcacttccacccaggtttgcgactccgtgccctgcgggtaaatctgatccggcgcaggggcgaacacaatgtccactttacgcttgttcagcttttcacagtcgtcctgcagggtacgcggataacgcgccagatcgtcggcacggtcaaactgcatcggattgacaaaaatgctcgccaccaccacatcggcggcgtttcgcgcttcatccaccagcttcatatggccgtcgtgcaggttacccatagtggggaccagcgcaatgcgtttaccttcctgacgcagacggcggatatgctggcgcagcagcggcagggtttcgataatcaacacaataagactccttaatggaaactgtgctcttcgccgggataaactcccgcttccacctcttccacgtactgacgcaccgcagcgcgcatatcgccggtaccggtgaggaagtttttagcaaattttggaatatgtccgccggtaatgccaaaggcgtcgtgcatcaccaggatctgcccgtcggtaacattgcccgcgccaataccgatgaccggaatgcgcagcgcgtcggtaatgcgtttcgccagttcaaccggcacgcactccagcaccagcagttgcgcgcctgcggcttctaacgccagcgcatcgtcaaacagcgtttgcgcggcatcgccccggccctgcactttatagccgccgaaaatattcaccgactgcggggttaagcccagatgaccgcacaccggcaccgcgcggtcggtcaacatttttaccgtctccgccagccagcgtccaccttcaattttgaccatgttggccccggcgcgcatcacttctgcggaactggcaaacgcctgttcaggcgtggcgtacgccataaacggcaggtcggcgagcagcaggcaatgcggcgcgccacggcgaacggcgcgcgtgtggtaggcaatatcttctaccgttaccggcagcgtggaatcatgtccttgtaccgtcatccctaacgaatcacccaccagcatgacgttgatcccttcttcggcaaagagtttggcgaagctgaaatcataggcagtgatggtggcgaagcgctttttttcctctttacatttcagtagcgaggagatggtggttggtttcataacgtttcctgatggagccttcagacttccggcattctatcagtaacattgatgcgaacaatgattttagccaggctttcgccaggcgaaagcaaggggagatttaccagagggcgggttttggcgcgccgcactgcgtcagtacgcaggcgaggggcgtgccgtccgggaagagcgcttccggggcaatttcaaacagcggccacagcataaagccacggttatgcatgtcgtaatggggaaccgtcaggcgggacgtgttaatcacctcatcgccaaacagcatgatgtccagatcgagggtgcgcggcccccagcgctcggctttgcgtacccgaccctgcgccagctcaatacgctgggtatgatcgagcagggcttcggcatcaagcgtggtttcaagcgcgacggcggcgttcaggtaatcgggttgatcctgcgggccaaggggcggcgtgcggtaaaacggtgaaagcgcaacaatctggctgtgcgggatctctcccagcgccgtgatggccgcgttcacctgctcaagaggtgaggccagattgctgccgatagcgatatacgccagcgtcatgcgctgccttcgcggcgcggcgcgcgtttgcgcggacggcggtgacggcgacgttcctgcggttcgtcgtccagcacgtcgagcatgcctttttgcgccggtggcgcggatacctggaattcaccccaccactgcgtcagacgttgcagttcgtggttgttttccgcttcggcacgcagcgccatcaaatcgtaggcggcgcggaatttcggatgctccatcagcttccaggcgcgtttaccctgacgacgggacatgcgcagctgtagctgccagatatcgcgcaccagcgtggtaatgcgtttcggaatagccagcgtgcggcaggcttcgtcgagcacatcgttcatcgccagcgcaaaggcgtcgtgataggtcagcccgctttcctgggcgatgcgctgcgcggtttccagctgcggataccacagcatggcggcgaacaggaaggctggattgacgcgcatatcgttatgaatgcggttatcggtattcttcagcacctgatcgatgatgcgttccatcggcgtatcgccgctctcggtaaagtagcgggtaatggtcgggaacagcggctggaaaaggctgtattcgcgcagcagcttataggtttcgtaaccgtagcccgcctgcaaaagcttgagggactcttcaaacaggcgcgccggcggcacgtcgttgatgagcgtcgccaggcgcgggatcggctcggcggtttcgtcgctgatacgcatatgcagtttggcggcaaagcgcaccgcgcgcagcatacgcaccggatcttcccgatagcgggtttccggattgccgatcagacggatcacgccgtcttccagatcgcgcatcccgcccacataatcgcgcacggtaaaatcggcgacgctgtaatagaggctgttgatggtgaaatcgcggcgctgcgcatcatcttcgatggagccgaaaatgttatcgcgcagcagcatgccattctggccacgctgggaagtggtgcgatcggcagcctgctcttcatgatgcccgcggaaagtggcgacctcgataatctccgggccaaacatcacgtgcgcaagacgaaaacgacgaccgaccagacggcagttgcggaacagcttacgcacctgatccggcgtggcgttggtggtgacgtcgaaatcttttggctttttgcccagcaacaggtcacgcaccccgccgccgaccaggtatgactcatagccggctttattcaggcgatagaggaccttgagggcattttcactgatatctttgcgggaaatcgtgtgctgctcacgcgggataaccgtcatctttggttcggcgatggcgacgtcttcggccatgctctcctcgcggcttagcaccttgcggcaaaaattagcgactcgggtaaaaatagtgcacctcggttgtgtcagtcttctggacaaaaaaattgcggcttatcatagctcagcgtggggcatttgagaatgccggattcacgcaggcttgctccggcacccgtgacagggaccagttttgcaccgctcgttgtagcagggcgtccacggacagatcctgccattcttctgttacatcctgatttaaaaacgctaacgcgctgataagtatggggcgcgggtccccctgcggcagcgccggagcgtgattctgcttcgacagcttatcgccggcggcattgagcgccagcggcaggtggatatactccggcaccgcccagccaagcagttgatagagcgaaatctggcgtaccgtcggttcaatcaaatccgcgccgcgcacaatttccgtcacgccctggaaatgatcgtccaccaccaccgccagattatatgcaaataacccatcacggcgatgaataataaaatcttcatgcgccagcgccgcatcggcgacgatctcgccgcgcagccgatcgtgaaaacgggtcaccggttgatgctgaataagccgcagcgcagcgttttccgggccattgccccgcgtccggcagtagccgtcatagacgccgccaatgctctgaatacgcgccctggtgcaggtgcagtaatagcagcgctcttgttggtgcagctgttgcagaatgtcgcggtaggcgtcatgacgccgggactgccacagcacgtcgccatcccagtgcaaaccatagtgttcgagctggcgcagaatagtgttagcggcgccggggacttcacgcgggggatcaatatcttcgatacgtaccagccagcgaccggcatgggcgcgcgcctgtaaatagctgccaagggcggcgatcagcgaaccgaaatggagttcaccagaaggggatggcgcaaagcgcccgatataatcagcgtcaggcatggttgggtaaagctaagagggcgggagagactcccgcctgagagaacattacgaaagcgccgcaggttaacccgccatttgtttttcgcggatttctgccagtgttttgcagtcgatgcacaggtcagccgtaggacgggcttccaggcggcgaatgccgatttcaacaccgcaggactcgcagaagccgaagtcttcgtcttccactttcttaagcgttttctcgatctttttgatcagtttacgttcgcggtcacggttacgcagttcaaggctgaactcttcttcctgtgcggcacggtctaccggatcagggaagttagcggcttcgtcctgcatatgtgtgacagtgcgatcgacttcgtccctaagttgattacgccacgcttccagaatgcgtttgaaatgcgtgagctgggcttcgttcatatactcttcgcccggcttctcctggtatggctccaccccagcgatggcgagaatactcagggacgatgttttacggttttgcccttcttgcatgttgtttctccttaacacgcactatcgatccccgtgttggggaaaaatcaggccgctataaatagcagatgcttttcaggatagcaattatctaaacgttacacttgacaaccctgtgaggaaaagcgtatttgcgcacgtaggccagcacactatttactcagccactatacctttaaaattcggcagatagcggcattgtcagactcataatttcggcagaaagttccgctttataaatcagaatttctaccccctgccgctgcgcttcactgagaagctgtgcgtatttaggatcaatgtggcgagccggtgaaaatcggtcaatggctgaatgcagcacggcaaacaacagcactgcccgatcccctgcggccgccacgctcatcaactcacgcagatgcttctgcccccgcagcgtgaccgcatcggggaaatagccctgcgccttatcggccagcgtgactgatttcacttcaatatagcagttgcggcggtcttctgcctgtaacatgaaatcaatacggctctgctcagaaccatatttcacttcacttttcaaagtgctatagcccgttagtgttggcaaacgatctgccattaatgcctctttcactaacatattggcgcgcaaagtattgacgcaaatccacgcgcccgcttgcgtttgagttaattcccaggtgtgtgcatatttccgtttagtattttctgaagtggaataccagacggtgtcgccaggcgtcgcgcaaccggtcatcgcgccggtattcgggcagtgcagggtcagggtttcacctgtgggcgtcaccacatccgccagaaagcgtttataacgctggatcagggtggcggactgaagcggcggagaaaactgcataggtcattccttttggctgagcgtccagcggctgagcgccgtgtaacgcgtacgtcccttaataaactgcgattcatacagcacaaattcattcaccggaaacgaccagcgaaagcccggcggcggtatagtgaccgcatggctggcgtcgcgcagcagcgtaacgtgcgggtgaaacggctgcgggctttgatagcatccactgcgggcggcctgcgcgcgcagcatactcgccagttgcagcaggccccgcggcggctgacgggtaccgagccagacgacccgcgagcgcagccactgtccggcatcatcgagcgtcagcgtaaagcctggctggcggatacgcccggccagctcgcacaacgcccgctgtttgtcagcgctcacatcgcctaaaaacgccagcgtcaggtgcagattagccgccgcgatcgggcgaccggcgtccggagcaaagtgcgcggcgcgccagtggatcacctgctgctgtacgtcagcgggcagttcaaggccgaaaaacagccgtctggtatctggcataagggatactcggtaatgatttacggcgatgctacaatgcacgccgatgaaatgaaagttaacccactggagccctgcgtgtcctctttgccggttgccgccgtactgcctgaattgcttgccgcgctgaaaagcgcctcctgcgtgctgcttaatgcgcccaccggggccgggaaatccacctggctgccgttgcaaattctgcaacagggcgagattgcaggccgcattttactccttgagccgcgccgactggcggcgcgtaacgtcgcgcagcggctggcggaaagcctgaatgaaaagcccggcgacaccgtcggctaccgaatgcgtgccgaaacctgcgtcgggccgcagacccgcctcgaagtggtcactgaagggatcctcacgcgcatgatccagcaggatccggaactgaccggcgtggggctggtgatcctcgatgaattccacgaacgcagcgtacaggcagatctggcgctggcgctgctgctggatgtgcaacaagggctgcgggacgatctcaaattattgattatgtcggcgacgctggataacgaacggctgcgcgggctactgcccgatgcgccggtgattgcgtccgaaggccgcgcgtttcccgtggaacggcgctaccagccgctgcccgcgcatcagcgtaccgatgaagctatcgccattgccaccgccgaactgctgcgggcggagcgcggctcgctgctgctgtttctgccgggcgtcggcgagatccagcgcgtgcaggaacacctcgcctcgcgcgtgggtgcggatgtccagctctgtccgttatacggcgcgctgccgctggccgaacagcgtaaagccattcttcccgcaccggaggggctgcgcaaagtggtgctggcgaccaacattgcggaaaccagtctgaccatcgaaggcattcgcttagtggtggacagcgcccaggagcgggtggcgcgtttcgatccccgtaccgggctgacgcggctggtgacccagcgtatcagccaggcgtcgatgacccagcgcgcaggccgcgccgggcgactggaggcggggatctgcgtgcatctgctggcaaaagatcaggcggaacgcgccgccgggcagagcgaggcggagatcctgcaaagcgatctctccggtctgctgctggagttgctgcaatggggatgcccggatccggcgcagctgtgttttctggatgcgccgcccgccgcgaatctggccgcagcaagaacattactgacgcagctccaggcgctggcggacgatcgcctgaccccgcgcgggcagaaaatcgcgcagctcggcaccgatccgcgtcacggggcgatgcttatcgccgcgaacacgccggataagatcgccaccgccgcgaaactggtcgccattcttgaagagccgccgcgtggcgggaatagcgatttaagcgtcgccttctcacgcagtcagccgcactggcagcgccgcagccagcagttgattaaacgcctcaacgcgcgggcaggcgcggaggacagcgatctgctccccggtctgctggcctgtggttttgctgaccgtatcgcccgccgtcgcgggcaggaaggacgctaccagttggcgaatggcatgggcgtgatgctcgacagcgacgatgcgctggggcgtcatgagtggctgatcgcgcccttgctgttgcagggcagccatacgccggacgcgcgcattttgcaggcgctggcgctggacattaatgcgctggtcaccgcgcacccggaattattacgccagtctgatacggtggaatgggatgacgtgcagggcacgctgaaagcctttcgccgcagtcagattggacagctaacattaaacgtcaggccgctggcgaaaccgtcggaagaagagctgcatctggcgatgctcaacggcatccgcgagaagggcttgcaggtgctgaactggacgccggaagcgcagcaactgcgattgcgtctgcactgcgctgcaaaatggctgccggaaacggcatggcccgccgtggatgatgactcgcttttggcaacgcttgagctatggttacttcccggcatgcagggcgttcactccctgcgcgccctgaaagcgctggatgtgtgccgggcgctggaaaatttgctgagctggccgatgcgtcaacggctggatagtgcgctgccgtcgcattacactgtgccgacggaaagccggatagccattcgttatcacgaggataacgacccggtgctggcggtgcggatgcaggagatgtttggcgaggcgaccacgcccgccattgccgacgggcgcgtgccgctggtgctggagctgctgtctcccgcccgccgtcccttacagatcacgcgcgatctcagcgcgttctggcagggcgcgtaccgtgaagtgcagaaagagatgaaagggcgctatcccaaacatgtctggccggatgacccggcaacggcagcgcccacccggcgtactaaaaagtattcacaggcataatcacatcctgtaggccggataagcgtcagcgccatccggcacgagtgcaatgaactttgagagatttcttcttccgccattttgcggaagcaatgaggatcgggccttgcgcctgaaaaatgtagcggagagtaaacatggcggggaatgaccgcgaacctattggacgcaaaggccgacctgcgcgtccggtaaaagaaaaagtaagccgtcgtcgactcagagatgaagacgcggatgattatgatgatgaggacgacgaaccgatgccgcgccggactaaaggtaaaggcaaaggcaaaaaacctcgcggcaaacgcggctggttctggctgctggtaaaaatcggcattgttattcttgtactgctggcgatatacggcctgtatctcgaccagaagatccgcagccgcattgacggcaaagtctggcaattgcctgccgccgtgtatggccgcatggttaaccttgagccggacatggcggtcagcaaaaacgagatggtgaagctgctggaagccacgcagtaccgcaaggtgacggcgatgacccgccccggcgagtttaccgtgcaggctaacagcatcgagatgatccgccgtccgttcgatttcccggacagcaaagaggggcaggtgcgcgcgcgtctgaccttcagcggcgaccgtctggaaaccattgagaacatggagaacaaccgccagttcggtttcttccgtctcgatccgcggctgatcaccatgctctcctcgccgaacggcgagcagcgcctgtttgtgccgcgcagtggtttcccggatctgctggtggataccctgctggcgaccgaagaccgccatttctatgagcatgacggtatcagcttctactccatcgggcgtgcggtgctggcgaacctgacggcagggcgcacggtgcagggggcgagtacgcttacccagcagctggtgaaaaacctgttcctctccagcgaacgctcgtatggccgtaaagcgaacgaagcttatatggcgctgatcatggatgcgcgctacagcaaagaccgtatccttgagctctatatgaacgaggtgtacctcggtcagagcggcgacaacgagatccgcggcttcccgctggcgagcctgtactacttcgggcgtccggtggaagagctgagccttgaccagcaggcgctgctggtgggcatggtaaaaggcgcgtccatttataacccgtggcgtaacccgaaactggcgctggagcgtcgtaacctggtcctgcgtctgctgcaacagcagcaggttatcgatcaggagctttacgacatgctgagcgcccgtccgctgggcgtgcagccgcgcggcggcgttatttccccgcagcctgcctttatgcagatggtgcgtcaggagttgcaggcgaagctgggcgataaagtgaaagatctctccggcgtgaagatcttcaccacctttgactcggtggcgcaggacgccgccgagaaagcggcggtggaaggtattccggcgctgatcaagcagcgtaagctgagcgatctggaaaccgcgatggtggtggtcgaccgcttcagcggcgaagtgcgcgccatggtcggcggagcgacgccgcagttcgccggttataaccgtgcgatgcaggcacgtcgttccattggctcgctggcgaaaccggcgacctatctgaccgcgctgagccagccgaatcagtaccgtctgaatacggtgatcgccgatgcgcctatctccctgcgccagccaaatggccaggtgtggtcgccgcagaacgatgacaaacgcttcagcggccaggtgctgctggtggatgcgctgacccgttcaatgaacgtgccgacggtaaacctcgggatggcgcttggcctgccggcggtcaccgatacctggctgaaactgggcgcgccgaaagatcagctgcatgcggtgccatccatgctgttaggggcgctgaacctgacgccggtggaagtggcgcaggcgttccagactatcgccagcggcggtaaccgcgcgacgctctcttcgctgcgttcggtgattgcggaagacggtacggtgctctaccagagcttcccgcaggcggagcgcgcagtgcctgctcaggcggcctatatgacgctgtggaccatgcagcaggtgatccagcgcggcaccgggcgtcagcttggcgcgaaatatccgggtctgcatctggcgggtaaaaccggcaccaccaacaataacgtcgacacctggtttgccgggatcgacgggcgtgaagtgaccatcacctgggtaggccgcgacaataaccagccgaccaaactctacggggcgagcggggcgatggccatctatcagcgctatctggcgaaccagtcgccgttcccgctggagctgaccgcgccggaagacatcgtcgatatgggcattgatgacgcaggcaacttcatgtgcgctggcggaagttcccgtactatcccggtgtggaccaccaacccggacagcctgtgccagcagagccaggcgttgcagcagtcgaataatccgttcgatcagtctgcgccgcagcagccgcaacagcagcctcagcaacagcaacaacaaccgccgcagcaggaagaaaaaagcgacggcgtagcgggctggatcaaggatatgttcggcggtaactaagcgttacccgcctgtatcaccgcctcagagtcgattaacgtcgctctggggcgttttttttaagattgttccctgcttattcctcccggtcatgctttccatttcctaatgtatgccacttccttatgacgtcacaatcccggtgattaaacgggagttatattcattcaaccatagctttcatgtattaactctctgatcccgggtgtagtgggacattactatttttctggtgaatatatggaataaaatttaataattaattaaatcttgtataagactaatcaaaagcatttttaatatgagtcttccttgtcagggtcttaaatatttgctggcttcaggaaattcctggtggttgcgttaactttcaggtgaaggtaatattagtaaataagatcgaatgaacgtgaggtgtatatggatatcttttcacttcataagctcattcttatggttggttaaaatattaactccccggtttatcatttttgtgatgtaaatttttttatagacatatgtaaggaacacgttatgtataaaaaatattttctgccactgcttgctggcgcgctgtttactacctccgtttcgccagttcaggcgaccgataccggtactattagctttaacgggaaaatcgtcgccgacagttgcaacgttaacgtgaacggcgcagtcactaacggcattgtgacgttcaggaacctgacgcaaacttcatttggcgaggataaaaaagtgggtgatagccagccttttaagattaccgtacgcaactgcgataccagcatctcttttattaacatcaagttctccggcgatcgcatcgcaggttatgacgatgaagttctgggaaccaccggtgttgccaataatgtagggatccgcatgtacccggaatacagcagtaacacctttattaaatttgacgggacagaaccaccctctgccgcaaaacaaaatgtgcaggggatggacgtcgtatttaactacaccgctgaagttattcaggttggtgcggatttaccgactgcgggtgattattccgcgcaagctacatacaccctggtttatcgttaatttatcaagataaactggcccagggcgggccagtattttcaatggaatgaaggaaatgcgaatttataatgccatactcgggatcttctttctgctgggcgctaccctggcgcaggcgggcgtcgtcattggcggaacgcgaattatttatccctcagaccaggctgaagtccaggtcacgttaaaaaataaagatgatgctaagcgttatctggtgcatagctgggtcagcaatattgatgacagcaaagcgccctttgtcatcacgccgcccatttacaagctcgatgaaaatcgtcaaacgctgctgcatgtcgtctataccggcgataaaacacatttaccccaggatcgcgaatccttgtttatggcaaatatcaaatcggtgtcttctgtgcctgaagaactgcgcgataaaaatactctgcaatttgcgatcaagacgaaaatcaaactgttttatcgcccatcggcattaagcgatgccgccgcgaaaacggcatggcagtcgttacagttcagccgccgcaataatcagttgacgatcaaaaaccccacgccgttttacgttaccctgggccagcttaaggtggcgcagaaagaggtaaaaccgctcggcaagcaggataccccttccgcgctatccatgatgatcgccccttatggcgagcaggtttttgccctgccgacggcggcgcaggggtcagtgatgtggaccgcgatcaacgattttggcgccgagaccgaaccgcgtcagcaagcgttataacctggctgtgaatttatcgtgggtggcgtttatgtcttcctggcgtaatggccggatttttgggctgagcgcgctggcactggcaatatcaacggtgaccagcgccgtgtatgctgaagactatttcaacctcggcgcactggaaacagagacacccctggaaaataccggggctattgaagcctggctgcgtaataacggcttgacgcctggccagtatctgacgtctatcgtctggaatgaggatcgccttgataaaagaaacctcaattacctcctgtcgaaagacaataaacaactcattccgcaatttaccaaagccgaactggctgaactgggcgtaaaggtcgataccgttccggcattacatgagcttgcggataatgcgacggtaggcgacatcagtgagtacattcctggggcacgttatgatttcagtccggacacccaggtgttgcaactgcatatcccccagatgtatcgcaatacgcggatctcaggcgaaactaatccggcaaactgggatgacggtatgcccgcaatctggtccagttattatgtttctggcgcgcgtcagcaatctgaatccaccagcagcgtggcaaactgggcaagcctgaactccggtctgaacatggggccctggcgcgtacgtaataccagtagctgggcgagtgacactggctggcagtccatcagcagcacccttgagcgcgatattaaacgcttacgcggccagtttcgcgccggacagacctcgactaacggcgagctgttcgacagcgtgcagatgacaggcgtaaccctggaaacggacaccgctatgttgccaggcggattacagggatttgccccggtagttcggggtatcgctaacagcgacgcgaaggtgaccgttaagcaaaatggttacatcatttatcagaccaacgtctcggcagggccttttgagctgcgcgatctcacgcaggtgacggcaggcgccgatctcgaagtgacggttgaggaagccgatggtacacagcgaagctttatccaggccagttcgtccgttcccatcatgcagcgtgaaggcgcgctgaaatacagcctttcagcgggtaaataccgcgatgttaatcatggcgcagagccgggctttggtcaggcgacggtgatttatggtctgccattcggcacaacggtttacggcggcgtacttggcgcctctatgtatcgcgccggtttggttggtgtgggagccgatttgcgccgtctgggctccctgtcgctggatctgacgcaggcacacacttcttttacagatgaacgtggcgataagaaggggcagtcatggcgtgcgcagtacgcgaaagactttccggcaaccgatactacgctgacgctggccagctaccgctattccacgtctggcttctacacttttcaggaagccctggatcagcgcaatggcggctatgacagcagcgatatgtacagctatcgcaacgtctacaacagacgcagccgcttgcaactcaatctttcccagtcactacggggatggggttccgtctatgctaacacctggcagcaaaactactggggaatggcggggcgcgagcgcagcgtcagctttggctacagcagcagctggcacggggcgaactggtcagtgaattacagcctgaccaaaacgcccacgacccgtgacgaccggcaactcgctctgtcactgaatattccgctgtcacgctttttgccggaagcctgggccacttacagtctaaacagggcgaaaaatggccccgcgtcgcaccaggtgggtcttaacggctcgttgctggaagacaataacttgacctataacctccagcagacctacaccagcgaccaggctggcaatggcgcttatctctcctcccgctatcgcgcctctatgggcgatttcagcaccaactacagctaccagaaaaacagtaaacagtggggatatagcgcacagggttcagtggtggcgcattcccatggcgtaaccctggggcgtacggtgcaggacgcttttgccgtggtgcatattaccgatggcgatcatgtgaaagtgcagagttcacagggcatttataccgacgcctggggcaacgccatcgttcccacgctgaccccttaccggcgcaataccattacggtgaacacgcaggggcgggatgatattgatattcaggatgccgcggtcgaagccattccgacaaaaggggccgttctggcagccgatttttccgcccgctcgggtaaacgcgcgctgttaaccctgacgcaccgtgagggcgtagtgccattcggcgcggtgttcagtatcgaaggcatgacggcgattgtgggtgatggcggtgaggtctacgtgacgggattaaagggtacgcaagcgttcaccgtgcaatggggcgatacgccggagacgcgctgcgcaggcaggatcaccgtgccgaaaaaaatggatgccaggtttctgatgagaaccgtcagctgcgaataaacaggacgttgagatgaaaaataaaatgttgttaatggcagggcgctgcggtcttgggttgctgctgatcggttcggcgttattgagtacggccgcgcgggcgtcgtgcaccattcttgacagaaaacctgctgcaaggattggattcgcgccgccgacattaatcgtcaacagcgatgctgaacctggtacgatcatttatagcgagcgtcagtccagctatacgatcagagttgaatgtactgccgttgcggacatctggcagggttataccaatgtcaacgcaactgacgagcgggcggacaatcccctgcagggcgtctatcaaaccaatgtgccgggtatcggctttcgcgccgcctggacaaacgcgactacgccaacattcgaagccgacgatatcgtcaggccctggcacagagatatgtcgcctgttatcaaagagaatggctattacaccttaacgctcaacggcgcggcgcagtttgtcgtgaccgggccggtgagttcggggatggtgtacatcggtaaatttaatgccgaatggaagtacgataacaccgtcgtcggctacctgagctacagctccagcctcgttgaagtgcagcacacgacctgtaatctggtggaaaaaaacatcaccgtgcctttagaggagattaatgcgagtgagtttacaaataatgtctcaagggtggtatccgatgacaggtttaagctccagattgataactgcgacgccggaagaaaaatcgattaccgcttcactaccgcaggttcgactggcgtgacaaacggcaatatcctgaatattgcggcagaagaaggggccgctcagggtgtgggtatccagatcctgaacagtaataatgcggtgttgcagtttgaccaggagtatacggcggtgtcacaaaccagcgccgggcagtcggtcactatcccgctaaaagcgcgctatatcaaaaccggcaccgtcaaaggcgggcatgtcaacgcggcggcgacttttgaggtttactatcgctgaaatgtgaactttgcatgggttattaaacattcgggcacatcttttttaccctttctgatcatctgattatttcttaaaccctcaattcttgtagggccgcatatcccttgctttcaagccggatgctcgcataatatgctgcggtcataataataattatcgtttacgttatcattcatcccattccagagagacacacaatggcgcgtcctgaaacggctctgccggtcaattcttcactgcgtaaaatcgcagtcgtggtcgctaccgcaatcagcggcatgtctttttatgcccatgcagctgaagacactattactgtcaccacctccgccgccccgcaggaaagcgcgtggggcccggcggcgacaattgctgccaaacacacggcaacagcaaccaaaaccgatacgccgattgaaaagacgccgcagtcgatttcggtggtaacgcgtgaagagatggatcttaaacaacccggcacggtaaaagacgcgctgagctatacgccgggcgtattcgccacgcgcggcagctccaccacttttgatgtggtgtctatccgtggtttcaccacttccacgacggtgaacaccaaccagtatctcgacggcatgaagctgcagggtgataactactctgaagcgtccatcgatccctatttccttgagcgtgtggaattgctgcgcggcccggtttctgtgctgtacggcaaaagccatccgggcggcgtggtcagtatggtgactaaacgcccgacgacggaaccgctgaaagaagtgcagttcaaaatgggcacccacaacctgtggcagacgggatttgatttcagcgatgccattgatgataacggcgaattctcttaccgcttaaccggtctgggccgtagccagaacgcgcagcaggagaatattaaatccacacgttatgccgttgcgcctgccttcagctggcgtccggatgacaaaaccgacttcaccttgctgagcaatttccagagcgatccggatgcaggctactatggctggttgccgcgtgaagggacggtggtgccgtattacgatgccgccggtaacgcgcacaagctgccgaccgacttcaacgaaggtgagaaagataaccgcctgtcccgtcgtcagcagctgattggctacagttttgcccatggctttgacgataccttcacggtgcgtcagaacctgcgttacacccgtgtccatacgctttatacctcgacatacggcaacggctatcaggcaccggcgcaaatcaatcgcgcctttgtgcgctccgatgaagatctgaactccttcaccgtggatacgcagctgcagtctgatttcgccaccggcgcggttgatcatactctgctgaccggtgtcgattacctgcggatgcgtaacgatattgatgcggattatggcaccgccaatccgatcagcatgaccaacccgcagtacggcaatgcgaacgtcaatatcaacttcccgtatgcggtgatcaaccgtcaggaacagacgggcctgtacgtgcaggatcaggcggaatggaacaaatggatcctgaccttaggcggtcgctacgactttgcgaagacctccacctttacccgctcttccggtacgctggctgaaatcaacgatgagcagttcacctggcgtggtggcctgaactatgtgtttgataacggcattgcgccttacatcagctacagcgaatccttcgagccgatttccggttcgacccagggcggtaaaccattcgatccgtcccgcggcaagcagtatgaagcgggcgtgaaatacgtgcctaaagatctgccggtgacggtgacggcggcggtttatcagctgaccaaggacaaaaacctgacggcggatccggcaaataccgccttcagcgtgcagggcggcgagatccgctcgcgtggtttcgagttagaagcgaaagccgcagcgacgcaaaatatcgatatcacggcgtcctacacctttaccgatgcggaatacacccacgacaccctgtttgaaggcaaacgtccggcggaaatcccacgcaacatggcttcgctgtgggcagactacaccttccatgaaacggcgctcagcggcctgaccgttggcgcaggcgcgcgttatgttggcaacaccaccagtttctacggcagcggtccgaagacaaaccagacctttaacgtagcgagctacacggtggctgatgcgatggtgaaatacgatctggcgcgctttggcctgccggggtcgtccattggcgtgaacgtcaacaacctgtttgaccgcgaatacgtctccagctgctaccgcgatcacgcctgttactggggcgcggaacgccagattgtcggtaccgcaaccttccgcttctaatctccttttgggcacggcttgccgtgccctttttacaagttggcgctatgcaggaaaacaactcccatcccgataccacgtttcgtcttaccgatgtcgccttccgggtgcctggccgcacgctgctgcacccgctgtcgttaaccttcccggtgggcaaagtgaccggtcttattggtcataacggttccggtaaatccaccctgctgaaaatgcttggccgccaccagccgccgtcggacggcgatattttgctggacggacaaccgctggacagctggaacagcaaagcctttgcccgcaaagtggcctatctgccgcagcagttgccgcaggcggaaggcatgacggtgcgcgaactggtggcgatagggcgttatccctggcatggcgcgctggggcgttttggtgtcgccgacagggaaaaagtcgacgaagccattgcgctggtgggattaaaaccgctggcgcaccgtctggtggacagcctctccggcggcgagcgtcagcgggcgtggatcgccatgctggtagcgcaggacagccgctgcctgctgctcgacgaaccgacctcggcgctcgacatcgcccatcaggtggatgtgctggcgctggtacaccgcctcagccagcagcgcggcctgacggtgatcgccgtgctgcacgatattaatatggcggcgcgttactgcgattttctggtggcgctgcgcggcggggagaagatcgccgaaggcacgccggaatcgctgatgcgcgccgatacgctggaaaaaatctacggtatcccgatgggcattctgcctcacccgacaggggctgcaccggtgagctttgttctctgatgactgacgtaaacctctttagccgtcgccgcctgctgacggcgatggccctgtcgccgctgctgctgaaaatgggcagcgcccgcgcggcggctgtcgatccgcatcgcatcgtcgccctggaatggctgccggtggaactgctgctggcgctcggcatcaccccctatggcgttgccgatgtgcccaactacaacctatgggtcaacgaaccggcgctgcccgactcggtgatcgacattggcctgcgcaccgagccgaatctcgaactgctcacccagatgaaaccctcgtatatggtctggtctgccggctatggcccgtcggcggatgtgctggcgcgtatcgcccctggccgtggattcaccttcagcgacggcaaaaagccgctcaccatggcgcgtcagtcgctccaggaaatggcgcagctgattggccgggagccagccgcgcgggcgcatctcaatgaattcgatgcttttatcgattcgatgaaaccgcgctttgcgaagcgtggcgacaggccattactgatggtcacgctgctggatgcgcgccatatgctggtgttctgcccgaactgcctgttccaggagccgcttgacgcctttggtattcctaatgcctggcagggggaaaccaccttctggggcagtacggcggtgggtatcgaccggctgggcgaatttaaagatgtggatgtgctctgtttcgatcacggtaacgagcgggatatgcaggcgctgatggcgaccccgctatggcagtcgatgccttttgtgcgcgccggacgcttttatcgtgcgcctgcggtgtggttctacggcgccaccctgtcggcaatgcactttgtccgcgtgctggataaggtgatgggaggccaggcatgagccgtcgtatcgcgcctttcccggcggcgctgcttgccgtgctgtttatcgtcggccttggcctgacgtggaataacctcaacgtggcgctgccccgtgcgcagtggcagcagggtgtctggcaaccggatagtaattccattgagcagatgctgttccattacagcctgctgccgcggctggcgatttcattgctggtgggcgcaggactgggactggtgggcgtactgttccagcaggtgctgcgtaatccgctggcggagccgacgacgctgggcgtcgctaccggcgcgcagttggggatcaccatcaccacgctgtgggcgatgccgggggtgatgacctcgcagtttgccgcgctggccggggcctgcatggtgggcgcgctggtatttggcgtcgcctggggaaaacgcctctcgccggtgacgctgatcctcgccgggctggtggtcagtctgtattgcggggcgatcaatcagctgctggtgctttttcaccacgaccagctgcaaagcatgttcctgtggagcaccggcacgctgacgcagaccgactggagcgtcgtgcaacgcctgtggccgcagttgcttggcggcgcgctgctcacgctgctgctgctgcgtccgctgacgctgatggggctggatgacggcgtggcgcgtaacctgggcctggcgctgtcgctggccagacttggcgcgctgatgctggcgattgtgctcagcgcgctgctggtgaacgcggtgggtatcatcggttttatcggcctgttcgcgccgctgctggcaaaaatgctcggcgcgcggcggctgctgtcgcggctgctgctagccccgctgattggcgcgctgatcctctggctctctgatcaaatcgtgatctggctgatgcgggtgtggatggaaatctccaccggatcggtgacggcgctggtgggtgcgccgctgctgctgtggctgctgccgcgtcttaagagtatgaacgcgccctcaatggaagggggcgatcgcgtgtttactgagcgtcagcatgtgccctggtttgcgctggcgggcctcatcgtgctgctgctcggtatggcggcagcgctgtcgctggggcgggatgcagaagggtggcactgggcgagcggttcgctgctcaatgaactgatgcagtggcgcgcgccgcgaattctggcggcgctgacggcgggcgtgatgctggcggtggcgggctgcattatccagcgcctgacgggtaacccgatggccagccccgaagtgctgggcatcagctccggcgcggccttcggcgtggtggtgatgctgttctttgtgccgggcaacgcctttggctggctgctgccggcgggcagtctgggggcggcagtgacgcttatgatcattatgctggccgccgggcgcgggggattctcgccgcaccggatgctgctggcggggatggcgctcagtaccgcctttaccatgctgctgatgatgttgcaggcgagcggcgatccgcgtatggcgcagatcctgacgtggatctccggctcgacctacagcgccaccgccacgcaggtgatgtgggcgatggcagcgaccgttgtactgctggcgatcgcaccgctgtgccgccgctggctgaccattctgccgctcggcggtgaaacagcccgcgcggttggcgtggcgctcacgccgtcgcgcgtcgggctgctgttgctggcgtcctgtctgaccgccgccgcgaccatgaccatcggtccgctgagttttgtcggcctgatggcgccgcatattgcgcgcatgatgggcttccgccgtacaatgccgcatatggtgatgtctgccttaacggggggattactgctggtgtttgcggactggtgcggcaggatgatcatgttcccgtaccagatcccggcggggctgctgtcgacctttatcggtgcgccgtactttatttatttgctgaggaagcagagccggtgagacgtgccgggtggcggcagcgccttacctgacgatggttttgtcgggtggcgctacgcttacccgacctacggtactgcgattctgtaggcccggcaagcgaagcgccgccgggcacaacaacaactaaagctgtgcaaacaccttacgcgccgcatcaatcgtcttattgatatcttcttcgctgtgcgccaccgacataaagcccgcttcgaacgctgacggcgccaggtaaacgccttcgtccagcatcagatggaagaaacgcttaaagcgctccacgtcgcacttcagcacatcctgatagcaggtcacttcggcggcatcggtgaagaagatcccgaacatgccgccgacgtgattcaccaccagcggtacgcctgcttcctgcgccgcgtccagcagaccattcgccaggcgggtggtcagatcggtcagggtttcgtggataccaggctgggcgacttccgttaaacaggcgtagcctgccgccatggcaatcgggttgccggacagcgtacccgcctgatacaccgggccggtcggggccagcgcatccatcacctcacgacgcccgccaaaggcgcccaccggcatgccgccgccgatgattttgccgaggcaggtcagatccggcaccacatcgtagtaagcctgcgcgcccgccagcgccacgcggaacccggtcatcacttcgtcgatgatcagcagcgcgccaaactcatcgcacagcgcgcgcaggcccggcaggaagtccggctgcggcggaatgcagttcatgttgcccgcgacaggctccacgataatgcaggcgatctcctgcgggaactcctcgaacgcctgacgcacagacgccagatcgttataggtgcaggtcagggtatgcttcgcaaaatccgccggtacgcccggtgaattcggctggccgagggtcagcgcgccggagccggcttttaccagcaggcagtcagcgtgaccgtggtagcagccttcgaatttgatgattttgtcacgaccggtgaagccgcgcgccaggcggatggcgctcatggtggcttcggtaccggagttcaccatccgcaccatgtccatggtcggcaccagttcagttaccagcgccgccatttttacttccatttcggtcggtgcgccaaagctcaggccgcgctccgccgcttcgataaccgcgttacggatcgccgggtggttatgccccagcaccatcggtccccaggagccgacataatccacataggctttgccgtcggcgtcgtacaggtaagcaccatccgcacgctcaataaacagcggcgtaccgccgacgccggtaaacgcgcgtaccggcgagttcacgccgccggggatgagtttacgtgcggcgctatagaggtcttgagacttactcataagtgagttcctggttcgtggaaaaagggtttatgggccattctaaagtattcgccggaggttataaaagtttcccccgattgaaagggcacttttgtgggtatttttattgccaccatggcggtgcgcatgggtaaaataggccaactcatttgtgtgacgaattaattaagccaatatgaaagcagaaaattcttccttccgcacacagcaactggtgcgtttgcggcgcggcgatctgatccgccgtctgttgcagcgcgacaaaacgccgctggcgatactgctgatggcggcgctggtcggcaccctggcgggactggtgggcgtggcgttcgagaaagcggtgaacggcgtgtcaaacctgcgcatcggcacgctggcgcaggtggcggatcgcgcctggctggtatggccgctggcctttgtgctgtcggcactgctggcgatggtcggctattttctggtgcgacgcttcgcgccggaggcgggcggctcgggtattccggaaatcgagggcgcgctggaggagcttcgcccggtgcgctggtggcgcgtattaccggttaaattcatcggcggtatgggtacgctgggcgcgggtatggtgctggggcgcgaagggccgacggtacagcttggcggcaacgtcgggcgcatggtgctggatattttccgcatgcgcagcgccgaagcccgccacacgctgctggctaccggtgcggcggcggggctgtcggcagcgtttaacgcgccgctggcaggcattttgtttatcctcgaagagatgcgcccgcagtttcgctataacctgatttccataaaagccgtgtttaccggcgtgatcatgtcgagcattgtgtttcgcatttttaacggcgaaggggcggtgatcgaagtgggcaagctggcgaatgcgccggtgaatacgctgtggctgtatctggtgctcggcatggtcttcggctgcgtcgggccgctgtttaatacgctggtgctgcgcacgcaggatatgttcgcccgtctgcacggcggcaatattaaaaaatgggtgttgatcggcgggattatcggcgggctgtgcggtgtgctggggctgattgttccggaaatttccgggggcggctttatgctgatccctattgccgccgccggaaattacgcggtgggcatgctgctgttcatctttgttgccagggtgatcaccaccttattgtgcttttcatccggcgcgccgggcgggatattcgcgcctatgctggcgctgggaacgctgttaggcacggcgtttggtatggcctgcgccgggctgtttccggcttatcatctggaggcgggcaccttcgctattgccgggatgggcgcgctgctggcggcttccgtgcgtgcgccgctcaccggcatcgtgctggttctggagatgactgataattatcagctcattttgccaatgattattacctgtcttggcgcaacactactggcacaatttttaggcggcaaaccgttatactcgaccatccttgcccgtacgctggcgcgtcaggaagctgaccttgaggctaagacccacgcgcaggcattcagggagaatacttgaacgattcaccagggtattagataataatttaaagatcgggttaatttttgcccgcatcgccgtatcattgggagcaaaaaatgagtgatgaagtagccctgccgctgcagtttaccgaagccgcagccattaaagtaaaagatctgatcgcagacgaagacaacccgaacctgaagctgcgcgtctacattaccggcggcggttgcagcggcttccagtacggtttcacctttgacgatcaggttaacgatggcgacatgaccattgaaaaatccggcgtcgcgctggtggtggatccgatgagcctgcaatatctggtgggcggcgcggtggattataccgaaggtctggaaggatcgcgctttgtcgtgaccaacccgaacgccaaaagcacctgcggttgcggatcgtccttcagcatttaattctctgctctgttgtcgggcggcgacgccgtctcgcccggcctgcaaaacatcatcacattattttgtaggcccggtaagcgtagcgccaccgggcgaatcatgacagttccaggcccggtaagcgaagcgccaccgggcaatatcatgtcttatcgcggattatcatccagcgcaaaggtcggcagtttcagatgccagcggatcgccgccagacgaatggcgagcgtcaccaccatcccgatcatactcgccgtttccagcggtacgccgaaagtataaaacgccgtcgcatgcacgatgccgccgataatacaggctgtggcatagatttcggtgcgcaggatcattgggatttcccgcgccagcatatcgcggataataccgccgcccacgccggtgaccacgcccatacaaatcgccaccagcggcccggttccggccagaaacgccttattcacgccaatccccacgaagaccgctaaccccacggcatcgaacaccggcaatacccatttcggcaggcggcgcggctggcgcaccagcagaatggttaacaggcaggtgaccatagcgatcaccagatcggtgggatcttttacccagaacaccgggccgtgatccagcgccatatcgcggatggtgccgccgccgacggcggtcaccacccccagcaccagcacgccaaagggatccatacgcagtttgccggcaagcagtacgccggagatggcgaaaacggcggtgccgataatatccagccagtagacaagcattttattttacctgtgcgagagcggtacagagttgttttgcggcgaggataatacgcggggatgcacgttcaaaccagtcactattgagggctatcacctcacttttgagatgattattccagaatgcctgcactttcggaatggcgtccactccgccggtgaccacaatggcctgcggatcgcgggccagcacctgttcacggctcacctgcggccagggaacacgggcggaagcaaagatattttcaccgccgcacagcgtcaccacctggtgctggatggttccgctgccgctggtaaacagcgggtgagtgctgaactgcataaagacgcgtttcttcggcgtaccggcgtactgcgcttttaaggcggcataatcggtgagcatcgcctgagcactggcgtgcgcctgttcgggttgcgggctgtattcggcgaggcgctccagcgattgcgccacctgctcgatgctttcggcgtcaacccacagcacgcgaataccaaagcgggtgagctggttaacctgacgttccgcgttgccgccgcgccaggccagcaccacgtcgggcttaagcgccacgatgcgctcaaggttaatgccctgccagctggcgacctgctcaattttactggccgcgggcgggtaatcggaatggctgctgacgcccgccggcgtgatcccggcggcaaacgccagttcagtattggccggtgagagggaaatcacgcgcggcgcggcataaagccacgctggcgtcagcagaagcagggcggcaagcgccctgaaggaacccttagccacgcgccaggttctgcaccagcgtctcaaccatcaggctggactgcttcgccgccacgacgaggaattcctcgaagctcaggtgcgactcctgatccgccacgtcagaaatggcgcgtaccaccacaaaaggcacgcccatgttatggcagacgtgggcaatcgccgtggcttccatctcaacggcaatcgcctgtgggaagttatggcgaattttcgcgaggttttcggaaccattgataaaggcatcgccgctgacaatcagcccgcgcacggcgttcaggtttaattgcgcaatgcaggcttcggctgcggcaaccagtttttcgtcggctttaaagcccgccgggcagcccggcagctgaccgagttcgtaaccaaaggcagtgacatcggcatcgtggtaacgcgcttcgtcggaaaccacgatatcgcccactttcagcgttggcgcgagaccgcctgccgagccggtattgatgatcacatcaggtttgcagtgctccagcagcagcgtagcgcccatcgccgccgcgactttgccaatacccgatttcagcagggcgacttcagtgccattgagcgtaccggtgtaaatttcgcagcccgcgatattctgcgtctgacgattttcgattttgtcacgcagcagcgtcacttcttcttccattgcaccaataatgccaactttcatagagatactcgctaatgtgataagactgagttacgttttcagggcatagtctatcatggcaggcaggaatgcattacttcacatgacgcacgatcgcgggagaagaaatggctgagatcgattttcgcagaaaaataaactggcatcgccgctaccgctcaccgcagggcgtcaaaacggaacatgagatcctgcgcatctttgaaagcgatcgcgggcgcattgtaaattccccggcgatccgccgtctgcaacagaaaactcaggtcttcccgctggagcgcaatgccgccgtacgcacccggcttacgcactcgctggaagtacagcaggtggggcgttacatcgccaaagagatcttaagccgcctcaaagagcagcggctactggaaacctacggtctggccgaactgaccgggccgtttgaaagtatcgttgaaatggcctgtctgatgcatgacatcggcaacccgccgttcggccattttggcgaagcggcgatcaacgactggtttcgccagcgcctgttcccggaagatgccgccagccagccgctgagcagcgatcgctgtcaggtgaccgcgctgcgcctgcgggaaggggaggatgaactgaacggcctgcggcgaaaggtgcgccaggatttgtgtcattttgaaggtaatgcgcaggggatccggctggtacattcgctgatgcgtatgaacctcacctgggcgcaggtgggctgtattttaaaatatacccgtccggcgtggtgggtgggcgagccgcccgccagtcataattatttaatgaagaagcccggctattatttttccgaggaagcttacgtcgaccgcttacgtaaagagctggaactggatacgttcagccgtttcccgctcacctgggtaatggaagccgcggatgatatttcttattgcgtcgccgatctggaagacgccgtcgagaaaagaatatttaccgtcgagcagctttatcagcatctttatgatgcctggggcagccatgaaaaaggatcgctgtttgcacaggtcgtcgaaaatgcctgggataaatcccgcgccaaccgattaagccgcagcgccgaagatcagttctttatgtatttgcgggtcaacacgcttaataagctggtgccttacgcggcgcagcgctttattgataatctgccgcagattttctccggagaatttaatcatgcgctgctggaagacgaaagcggctacagccaattgcttgaattatataagagcgtcgcggttgaaaatgtcttcagccaccccgatgtagaacagctggaattgcaggggtaccgggtgatcagcggtttgctcgatatctatcggccgctgttgcaattaacgctcagcgattttagcgagctggcggaaaaagaacggctgcggcgtttcccgattgaaacccgcctttttcataagctctcaacccgtcaccggctggcgtatgtagaggcggtcagtaaattagatcgcgcggcgacagatttccctgtactggagttttattaccgttgtcgcctgatccaggactatatcagcggcatgacagatctgtacgcctgggatgaataccgccgtttaatggccgttgaataatagcgcagcaattgtaaagactgacaataaatttttacttttgcagaaagtccgttttggaacttcgcgctataaaatgactctcactgaaacaacacagcccttttgcgtaatcagtaatcagagattaaacaacatgaaaaaaacgacgttagccatgagtgcactggcattaagtttaggtttagcgctttctccgatgtcagctatggcggctgaaaccgcgtcctccgcgcaggccgctcagccgatgccgagtctggcgccgatgctggaaaaagtcatgccatcggtggtgagcatcaatgtggaaggcagcacgacggtgaacacgccgcgtatgggccgtaacttccagcagttctttggtgacgattcgccgttctgccaggaagggtcgccgttccagagttcgccgttctgccagggcggcgcgccgggcggatctgacggcggtcagcaacaaaaattcatggcgctgggttccggcgtaatcattgatgccgcaaaaggctatgtcgtcaccaataaccacgtggtggataacgccaccaccattaaagtgcagctgggcgacgggcgtaaattcgacgcgaaagttgtgggtaaagatccgcgctctgatctggcgctgatccagatccagagcccgaaaaacctgacggctatcaaacttgctgactccgacgcgctacgcgtgggtgactataccgtggcgatcggtaacccctttggcctgggcgaaaccgtgacctcggggatcgtttctgcgctgggacgtagcggcctgaacgcggaaaactatgaaaactttatccagacggatgcggccattaaccgcggtaactccggtggcgcgctggtgaacctgaacggcgagctgatcggtatcaacaccgcgatcctcgcgccggacggcggtaacatcggtatcggcttcgctatcccgagcaatatggtaaaaaacctgaccgcgcagatggtgcagtacggccaggtgcgtcgtggtgaactgggtattctgggaacagaactcaactctgagctggcgaaagcgatgaaagtcgacgctcagcgcggggccttcgtcagccaggtgatgccgaactcttccgccgcgaaagcgggcattaaagcgggcgatgtgatcaccaccctgaacggcaaggcgatcagcagctttgcggcgctgcgcgcggaagtcggctcaatgccaatcggcagcaaagtctcccttggcctgctgcgtgacggtaagccggtgaccgtcaatctggaactgcaacagagcagccagaaccaggtggaatccagcaccgtcttcagcggtattgaaggcgcggaaatgagcaacaaaggccaggatcagggcgtcaccatcagcaatgtgaaagccaattctccggcggcccgcattggcctgaaaaaaggcgatgtgatcattggcgcgaaccagcagcgtgtgaaaaatatcgctgagctgcgtaagatcctcgacagcaaaccgtcggtactggcgctgaatattcagcgtggcgacacctcgctgtatctgctgatgcagtaatccgccactcccttctccgccacggagaagggagttatccctccgttctgtgaagctttccacaactctacatttctgatccctgctctgtgcatttgcacaatgcgcgccgctattatcttttctattctggagcactgcttacgggagggatacatggctggctggcatcttgataccaaaatggcgcaggacatcgtgtcacgcacgatgtgcattatcgataccaatatcaacgtgatggatgcgcgtggccggatcatcggcagtggcgatcgggagcgtattggggaattgcacgaaggcgcgttgctggtgctgtctcagggtcgggtggtggatattgatgacgccgtggcgcgtcatctgcacggtgtgcgtcagggcattaaccttccgctgcgtctggaaggggagatcgtcggcgttatcggccttaccggtgaaccggagacgctgcgcaaatacggcgaactggtgtgcatgaccgccgaaatgatgcttgagcagtcccggttgatgcatctgttagcccaggacagccgcctgcgcgaagagctggtcatgaacctgatccaggcagaagagcacaccccggcgctgaccgaatgggcgcagcgtctgggcatcgatttaaatcagccgcgcgtggtcgcggtggtggaagtggacagcggccagctcggcgttgacagcgcgatggcggaacttcagcagttgcaaaatgccctgaccacgccggagcggaataacctgatcgccattgtgtcgctgacggagatggtggtgctgaaaccggcactcaatcagtttggccgctgggatgcggaagatcaccgcaagcgggtggaactgctgatttcgcgcatgaaagagaacgggcagttgcgctttcgcgtggcgctcggcaactattttaccgggccgggcagcatcgcccggtcatatcgtaccgcgcgtaccaccatgatggtgggtaaacagcggatgccggaaaaccgcagctatttttatcaggatttaatgctgccggtgctgctcgacagtctgcgcggcggctggcaggcaaatgaactctcccgtccgctggcgcgtctgaaagcgatggataacaacgggctgctcaggcgtacgctgacggcctggttccgccataacgtgcagccgctggcgacgtccaaagcgctgtttatccaccgtaatacgctggaataccggctcaaccgcatctcggaattaacaggtttagatttggggaattttgacgaccggctgctgctgtatgtggcgttgcagctggatgaacagcgttagataaaatatgccgggtggcggcttgcgccttacccggcctgtaaattcgcatcgttgcaggcccggtaagcgtgcgccaccgggcacgcgacggttatttattgcgggtcagcttttccagatcggcttcaatttcactgatcttattggtcacgaccgattccagatgacgaagatcgtctaagatcttacgcttcaggtcgacttccgtacgatcgcgctggcagatctgatccagctcatcgatcacgtaacgcaggttagggctgatttcctgcacttctttgtagccctgacccacgccatccgcgacaatggttttacgctggcgcgggtatttaaacttcacgcttttcgcgaaaaactcgcctttgtccttatgaaaatagattttcagaatatcgttattggcttcctgacggaggctgtagcgatcgatttcatccggattggtaatgcctaaacttttcagattatcgtacatagcggtacccttaagctcaacataacctatgaataattaacgaaaaaatctatcttcgccactgcgtcgtgcaaaaaaggcggggtgagtcaccctctccctgagggggagaggagataccttagtcgatcgtgcgcagcaattcgttaatgcctacttttccgcgtgttttcgcatctacttttttcacaatcaccgcgcagtacaggctgtaagagccgtctttagacggcaggttgccggagacaacaaccgagcctgccggcacgcggccataatgcacttcgccggtttcgcgatcgtaaatacgggtgctctgaccgatgtacacgcccatcgagatcacggaaccttcttccacgataacgccttccaccacttcagaacgtgcgccaatgaagcagttatcttcaatgatagtcgggttcgcctgcagtggctcaagaacaccaccaatacccacaccgccggagaggtgaacgttcttgccaatctgcgcgcaggaacccaccgtggcccaggtatccaccatggtgccttcatcgacgtacgcgccgatgttgacataggacggcatcagcacggtgttacgggcgatataggcaccctgacgcacggccgctggcggcaccacgcggaagccttctttctggaagcgcgcttcgtcgtagtcggcgaatttcatcggcactttgtcgaagtagcggctttcagcgccctcgatcactttgttatcgttaatgcggaaagagagcagcaccgctttcttcagccactggtgcgtcacccactgaccgtcaattttttctgcgacacgcagcgcgccggaatccagcagggcaataacctgattaaccgcttcacgggtaacggtatccacatttgccggggtgatgtcggcacggcgctcgaaagcggtctcaataacgttctgtaattgctgcatgtttactctttccatctgtataaaaaaaatcgttaccctttatcgtttggattgagggccgctgtcaaccgttgttgcacttcctgctggagcacattattaaggccacgccggtccgctgtggcgattataaataaatcttctactcgctcgccaattgtcgaaattctcgccccatgtaaggaaattccgaggtctgcaaacacctggccgacgcgggccagcagcccaggctgatcgagggcgatcagttcgaggaaggattttctgtccgtgtgggtcggcaggaaattgacctcggtgtcgacggtaaaatggcgcagttttgcgggctgtcggcgaggctgcggcggctgccagctgttctgggtgatcgcctgcagcagaccaaagcgaatgacctcatggcgatcagctgccagcggtttgccgtccggctccagcacgatgaaggtgtccatcgccatgccgtcgcgggtggtgaagatttgcgcgtcatgcacgctcaggttgcggcgatccagctcggcgcagaccgcggcaaacaggtaggggcgatcggggctccagataaagatttccgtgccgccgcgtgtggcctgcgggctgagcaggatcatcggctcgctcagatcgtgctgcaacagattacgcgcgtgccatgccagctgatttgggctgtggcgcacgaaatagttcgcccggcagcgcgcccagatatgatgcagcgcttcttcattaatgttgtccatgcgcaacagcgccagcgcctggatctgatgatgacgcacacgctcgcgcatatccggggtgttttgcattccgcgacgcagctgtttttccgtggcgaagtacagctcgcgcaacaggctctgcttccagctgttccacagggtttcattggtggcgcaaatgtccgccaccgtcaggcagaccaggaagcgcaggcggttttcggtctgtacttcttcggcgaactgcttaatgacttcgggatcctgaatatcacggcgctgggcagtcacggacatcaataaatgctggcgcaccagccaggcgaccagctgcgtttcccgtgagttcaggccatgcagttcggcgaatttcagcacgtcctgcgcgcccagcactgagtgatcgccgccgcgacctttggcgatatcgtggaacagagcggcaatgaggatcagctccggatgcgacaggcgcggccacagctccacgcacagcggatgcttctggcgcgtagcctcatcagcaaagctttccagcttcagcaggacgcggatggtgtgctcatccaccgtataggcatgaaacagatcgaactgcatctggccgacaatgtgcgaccactggggcatataggcccacagcacgctgtggcggtgcatcggcagcaggccacggctgaccgcgccggggtgacgcagcatgctgagaaacagcgtacgcgcttccgggataaaacagagcggctgcgtcagatgacgacgggcatggcgcaaatggcgcagggtggtggagtaaatgccggtgatgctgctgttgcgcaccatcatatagaacatgcgcagaatggcctgcggctcgcggataaacagcgtctcgtcccgcagatcgattagggtgccgcgcagttgaaactcatcgtcaatggcgcgcggtttttcatcggccgtcagcgcaagaatagcttcgtcaaacagttgcagcagcatctgattcagctcggtgacgcgacgggtcacgcgatagaagtctttcatcatatgctcgaccggctggttgccgtcgccggaatagttcaggcgctgggcgacgctcaactggcggtcaaacagcagacggttatcgtagcggttaagctccagatgcagcgcaaaacggatgcgccacagcagatgctgacattcgttcagttcgttacgttcggcctgagtcagaaagccgaagccaaccatctcgtttaaggaggtggcgccaaaatgacggcgggcgatccattgtaaggtgtggatgtcgcgcaggccgccggggctgtttttgatgtccggctcaaggttgtaactggtgccgtggtagcgttgatggcgctcgttttgctcttcaactttggcggcgaagaatttttccgacggccagaaaccgtcgctgaaaatgtgcttttgcagctccaggaacagcgcgacgtcgccaatcaacagccgggattcaatcagattggtggcgaccgtcagatccgataagccctccagcaggcactcttccagcgtgcgcacgctgtgcccgacttccagcttaatgtcccacagcagggtgagcagctcgccaatcttttgcgactgctcctctgagagctttttacggctgaggatcagcagatcgatatctgacagcggatgcagttcgccgcgtccgtaaccgcccaccgccaccagcgcggtgtcggcgacctcgccaaacccgtactccatccacaggcgctgtaacagctgatcgataaactcggtacgggcctcaatcagttgttcggcagaaagcccggcatcaaagacctcgcccagccagtgctggaaggcgtccagccgcgctttgatcccggcgcacgtcagctctcccgcaggccaggcgttagggttttccggctgaccgggcagggaaggggccgtgtgactgaactgctcgcagaggttatgactcatatcgcgcccatttataagaaaaaactatcgccataaaaaaagccggcaatcgccggcttcttcatcattcgttgtgcgagagtatcgccgggatggtgtcatcctttcgtaacgtcagaatttcgcagccgttatccgtcaccacaatagtatgctcgtattgagcagacaagctgcgatctttggttttcaccgtccagccgtctttcatggtgcgaatgcggtaatcgcccgcgttgaccataggctcaacggtaaaggtcataccggcctgcaacaccacgccgccgtcatccgcatcatagtgcagcacctgcggctcttcgtggaagccacgaccgatgccgtgtccgcaatattcgcgcaccacagagaagccttccgcttcgacaaatttctgaatggcggcgcccaggctgcgcagacgaatgcccggcttcaccaggcgcagggccagatagaggctctcctgggtgatgcggcataagcgctcgcccagaatggtcggtttgccgacgataaacatcctggaggtgtcgccgtggtaatcatctttgatcaccgtgacgtcgatattcacgatatcgccatctttcagcagtttttcgtcatccggaatgccatggcacaccacttcattaatagagatgcagacagacttcgggaaaccgtgatagccgaggcaggcagaaaccgccttttgctcattgacgatataatcgttacaaatacgatccagctcgccggtgctgacgccaggtttaacgaaaggctcgatcatttccagcacgtcggcagccagacggcccgccacgcgcattttttcgatttcttccgcagtcttaatagagatagccattgattctgtccatcggggtcgatcgggtcgaccataattgtgtaagtggcgtcaatggtatcagcctggcgcgccgcctgccagattgggaatgattaagcgcatccgtcgccaacaactgttggtgtcacgggcgtatttatggtataaagcgcgccggacttccgttccattttggcacgtgaagccacaaatctcactttgtgtaaataacacacacgtatcggcacatattccggggtgcccttcggggtcggtaatatgggatacgtggaggcataaccccaacttttatatagaggttttaatcatggcaactgtttccatgcgcgacatgctcaaggctggtgttcactttggtcaccagacccgttactggaacccgaaaatgaagcctttcatcttcggcgcacgtaacaaagttcacatcatcaaccttgagaaaactgtaccgatgttcaatgaagccctggctgaactgagcaagatctcttctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaaccgttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggcctgccggacgcactgtttgtaatcgatgctgaccacgaacacattgcaatcaaagaagcaaacaacctgggcatcccggtgttttctatcgttgataccaactccgatccggacggcgttgacttcgttatcccgggtaacgacgatgcaatccgtgctgtaaccctgtacctgagcgctgttgctgcaaccgtacgtgaaggccgttctcaggatctggctgcgcaggcggaagaaagcttcgtagaagctgaataataaggcacgctccccggagcccttattaaccaggtagtatcgagtttggttaaggggcctttttatggcccctttttcacttttaagctgtttggtcatcacgaccaggcagatcaaatctcccgaggattttagaatggctgaaattaccgcatccctggtaaaagaactgcgcgaacgtactggcgcaggcatgatggactgtaaaaaagcgctgactgaagccaatggcgacatcgagctggccatcgaaaacatgcgtaaatctggcgcgatcaaagcggcgaaaaaagcaggcaacgtagctgctgacggcgtgatcaaaaccaaaatcgacggcaactacggtgtgattctggaagttaactgccagactgacttcgttgctaaagacggtggtttccaggcgttcgctgacaaagtgctggatgctgcagttgctggcaaaatcactgacgttgacgtgctgaaagcgcagttcgaagaagagcgcgttgcgctggtggcaaaaatcggtgagaacatcaacattcgccgcgttgccgccctcgaaggcgatgtgctgggcagctacctgcacggcgcgcgtatcggcgttctgattgccgctaccggtgctgacgaagagctggttaagcagctggcaatgcatgttgctgcaagcaagccggaattcgttaagccggaagacgtgtctgctgaagtggtagagaaagaataccaggtacagctggacatcgccatgcagtctggcaagccgaaagaaatcgcagagaaaatggttgaaggccgcatgaagaaattcaccggcgaagtttctctgaccggtcagccgttcgttatcgatccgagcaaaactgttgctcagctgctgaaagagcacaacgctgacgtgactaacttcatccgcttcgaagtgggcgaaggcatcgagaaagttgagactgactttgcagcagaagttgctgccatgtccaagcagtcttaatcactaaaaggagccgcctgagggcggcttctttttgtaccccgctttaaaaaatcagcaaaatacctatgttgtttgtgctggtttgcgacgtaatatgtcgcctgaaataacccctctcaatcgttgacagtctcaggaaagaatcatggctaccaatgcaaaacccgtctataaacgcattcttctcaagcttagtggcgaagcgttacagggctccgaaggcttcggtattgacgcaagcatccttgaccgcatggcacaggaaattaaagagctggttgaattaggcatccaggtcggtgtggtgattggtggtggtaatcttttccgtggcgcaggtctggcgaaagcgggtatgaatcgcgtagtgggcgaccacatgggcatgctggctaccgtgatgaatggcctggcgatgcgtgacgcgctccaccgcgcctatgtgaacgcccgcctgatgtctgctattccgttgaatggcgtgtgtgacaactacagctgggcagaggcgatcagcctgctgcgtaataaccgcgtggtgatcctctcagccggtaccggcaacccgttctttaccactgactccgcagcctgcctgcgtggtatcgaaatcgaagccgatgtggtgctgaaagccaccaaggttgacggcgtgttctctgccgatccgatgcaggatccgaccgctaccctgtacgatcagctgagctatgctgatgtgctggatcgtgaactcaaagtcatggatctggcggcctttactctggctcgcgaccataaactgccgatccgcgtgttcaacatgaacaagccgggcgcgctgcgccgcgtggtcatgggtgaaaaagaaggcactttaatcacggactaatttccgtgagcgctaaataaaggtaagatcccgctttatttaaaagcgatttttatcagacactgtgacagtgtgatgaatgaaacgaggctatacttagcgcacctttgggtgtggctatgtgtggcctgcctgagacaagttttcaaggatccgtaacgtgataaacgacatcagaaaagatgctgaagtacgcatggaaaaatgcgtggaagcattcaaaacccaaatcagcaaagtgcgcactggccgcgcgtccccgagcctgctggacgggatcgttgtggagtactacggtaccccgaccccgctgcgtcagctggccagcgtcacggttgaagattcccgtacgctgaaaatcaacgtgttcgatcgttccatgggcccggccgttgagaaagcgatcatggcatccgatctgggtctgaacccgaactctgccggtagcgacattcgtgttccgctgcctgcgctgacggaagaacgtcgtaaagatctgatcaaagtggtgcgtggcgaagcggaaggcgcgcgcgttgccgtacgtaacgtccgtcgtgacgcgaacgataaagtgaaagcgctgctgaaagacaaagccatcagcgaagatgacgatcgtcgttcacaggaagaagtgcagaaacagaccgacgcggcgattaaaaaaatcgatgcggcgctggcggataaagaagcggaactgatgcagttctgatcctgcgcacatgatgacaacgccgtacagaaatccacagggtttgctggcggcgttttgctttctatcctccaaaattacgccgggcgtctgatgaagcaattaaccctccttggctcaaccggatctattggttgcagcactcttgatgtggttcgccacaatcctgaaaccttcgcggtgacggcgctcgtggccggtaaaaacgtggcgcggatggtcgaacagtgcctcgaattctcaccgcgctatgcggtgatggatgatgacgcctgcgcccgtcagttgaaagacgcgctggcgcagcacggcagccgtaccgaggtgcttagcggtcagcaggcggcctgtgacatggccgcgctggatgaggttgatcaggtgatggcggccattgtcggggcggcagggcttctgccgacgctggcggctattcgtgccggtaaaaccgtgctgcttgccaataaagagtcgctggtgacctgcggacgactgtttatggaagccgtgaagcacagcggcgcgcagcttttgccggtggacagcgaacataacgctatttttcagagtttaccgcaacctttccagcacaacctggggtacgctgatctggagcagaacggcgtgatgtcgattctgcttaccgggtctggtggcccatttcgcgaaacgccgctgtctgaactggctgcaatgacgcccgatcaggcctgccgccatccgaactggtcaatgggacgtaagatctccgttgattcagccaccatgatgaacaagggtctggaatacattgaagcacgctggttatttaatgcctccgccgatcagatggaagtgctgatccacccgcagtcggtgatccactccatggtacgttatctggatggcagcgtgttagcgcagctgggcgagccggatatgcgcacgccgatagcccatacgatggcctggcctaatcgtgtggtctcaggcgcgaagccgctggatttcagtacgctgagtgcactgacgttctgcgcgcctgattacgatcgttatccttgcctgaagctggcaatggacgcgtttgagcaggggcaggcggcaaccacagcgctgaatgcggcaaacgaagtgacggtcgcggccttcctggactcggctattcgctttaccgacattgctgccctgaatctgtctgtgcttgagaagatggatttgcgcgaaccgcaaagtatcgatgatgtactggctgttgataaacttgcgcgtgatgttgcacaaaaacaagtgacgcaactcgcaagctggtgatattacagccactcgtggttgtgctatttgttagcgtattacttcagtgatatagtctgcgccacctgatcgtggggcttttgtcctttcaggtcaggtaagccgtggttttacacggcttttttatgtaaaggcttcagtattcctggctaccgctaaatccttttcagggactaataacgcgttatgttgtctgctaatcaaccattaagcgagaatttgccagcgcatggctgccgtcatgttgcgataattatggatggcaatggtcgctgggcgaaaagacaagggaaattacgggcttttggtcataaagccggagccaagtctgttcgtcgtgcggtttcgtttgctgcgaataacggcatcgatgcattgacgctgtacgcttttagtagtgaaaactggaaccggccagcgcaggaagtcagcgcgctgatggaactgttcgtgtgggcgctggatagcgaagtaaaaagcctgcaccgccataatgtgcgtctgcacgtcatcggcgacaccagtcgttttaacgcccgtttgcaggaacggatccgtaaagctgaggccctgacggcacagaatacggggctgacgctgaatattgcagcgaactatggcgggcgttgggatattattcagggagtacagcatttagctgctcaggtccaggaagggctgttgcgccccgaccagattgatgaagacgcgctgagtaagcaaatctgcatgcatgaactggctcccgtagatttagtaattaggacagggggagaacatcgcataagtaactttttgttgtggcaaattgcctatgccgaactttactttactgatgttctttggcctgatttcgatgaacaagactttgaaggtgcgctgcatgcctttgccaatcgagagcgtcgtttcggcggcaccgagcctggtggcgacgaagcctgatgggggtagcttttgctgaagtatcgcctgatttctgcttttgtattaatccccgtcgttatcgcggcgctgttcttactgccgccggtgggatttgctattgtcactatcgccgtgtgcatgcttgccgcatgggagtgggggcagtttagcggtttcacgtcccggaacgcgcgggtatggctggcggtattgtgcgggctgctgcttgcgggctggctgttactgatgccggaataccattacaacgtccgccaaccgctggttgaaggcgcgctgtgggcatccttaggctggtggattgccgcgctgctgctggtgctgttttatccggcgtcggccagcctgtggcgacattcaaaagcgctacgtctcgtgttcggtatcctcaccattgtgccgttcttctggggaatgctgacgctgcgcgcctggcactatgacgataaccactacagcggcgcgctgtggctgctgtatgtcatgatcctcgtatggggcgcagactccggggcatacatgtttggtaaactgttcggcaagcataaactggcgccgaaagtatcgccgggcaaaacctggcaggggtttattggcggtttatttacggccgcggtaatatcctggggctatggcgtgtgggcaaatctggacgttgcgccttccacgctgctggtgtgctcaattgtcgcagcgcttgcctctgtactcggtgatttaacggaaagtatgtttaagcgtgaagccggtatcaaagatagcggtaaccttattccaggacacggcggtatacttgatcgcatagatagcctgacagcggcggtgccggtgtttgcctgtctgttattgctggtattcaggacgatttaacggaagattatatgctgagtattctctggaatctggcggcgttcattgttgcgctgggcgtgctgatcacggtgcatgaatttggccatttctgggttgctcgtcgttgtggtgtgcgggtagagcgtttttccatcggttttggtaaagcgctctggcgtcgcaccgataagcagggtacggaattcgttatcgcgcttatccctcttggcggttacgttaaaatgctggatgagcgcgtagagccggtgatcccggaactgcgccataccgcatttaacaacaaaaccgtcgggcagcgtgctgccgtcattgctgcgggtcccgtagccaatttcctctttgctatcgtcgcttactggctggtgtttatcatcggcgtgcctggcgtgcgcccggtaatcggtgaaataacacccaactcaatcgccgccagcgcgcaaattacgcccggcacggaacttaaagcgattgatggtatcgaaacgcctgactgggatgctgtgcgtttgcagctggtgtccaaaatcggcgatgcgcagactacaatcagcgtggccccctttggtactgacagccgtcagaacaagacgctggatttacgcgactgggcgtttgagcctgaccgcgaagatccggtcgcctcgctcggcattcagccacgcggtccgcagattgaaccggtactggcgcaagtgcaggctgactccgctgcaagtaaagcaggtttgcaagcaggcgacaggatcgttaaagtcgatggtcagcagttaacgcagtggatgacctttgtcacccttgtccgggataatcccggcacgccgttagcactggatatcgaaagacagggcagccccttgtctttgacactgataccagatacaaaaccgggtagcggcaaggacgaagggtttgcaggcgtggtgcctaaaattatcccgctgcctgacgagtacaagacagtacgccagtacggaccattcagcgccatcgttgaagccacggataaaacctggcaattgatgaagctgacggtcagtatgctggggaaattgataaccggtgatgtcaaactgaacaacctcagtgggccgatttctatcgcccagggggctgggatgtcagcagaatttgggttgatttactatctgatgttcctcgctcttatcagcgtgaaccttgggatcatcaacctgttcccgcttcctgttctggacggggggcacctgctgtttttagcgattgaaaagctaaagggcggaccggtatccgagcgagttcaagactttagttaccgcattggctcgattttgctggtgttgttaatggggcttgcacttttcaatgatttctctcggttatgagagctagttaggaagaacgcataataacgatggcgatgaaaaagttgctcatagcgtcgctgctgtttagcagcgccaccgtatacggtgctgatggattcgtagtgaaggacattcatttcgaaggccttcagcgtgtcgccgttggtgcggccctcctcagtatgccagtccgtcagggcgatacggttaatgatgaagatatcagtaataccattcgtgcgttgtttgccactggcaacttcgaggacgtccgcgtcctgcgtgatggcgatacccttcttgtacaggtgaaagaacgtccgactatcgccagcatcactttctctgggaacaaatcagtgaaagatgacatgctgaaacagaaccttgaggcttctggcgtgcgtgttggcgaatccctggatcgcaccaccctttccgatatcgaaaaagggctggaggatttctactacagcgtcggtaagtacagcgccagcgtaaaagcggtcgtcacgccgctgccgcgtaaccgtgttgacctgaaactggtcttccaggaaggcgtctcggcgaagatccagcagatcaacattgttggtaaccacgccttcagcaccgaagagttgatctcaaccttccagctgcgtgatgaagtgccatggtggaacgtggtaggcgatcgtaaataccagaaacagaaactggcgggcgatctggaaaccctgcgcagctactatctggatcgtggctatgcccgtttcaacattgattcgacgcaggtcagcctgacgccggataaaaaaggcatctacattaccgtaaacgtcaccgaaggcgatcagtacaagctttccggcgtggaggtcagcggtaatctggcaggtcactctgccgagattgaaagcctgaccaaaattgagccgggcgagctgtataacggcaccaaagtgaccaaaatggaagacgatattaaaaagcttcttggtcgctatggttatgcttacccgcgcgtacagtcgcagcctgaaatcaacgacacggataaaaccgttaagctgcatgtcaacgttgatgccggtaaccgctactacgttcgtaaaattcgctttgaaggtaacgacacctcgaaggatgccgttctgcgtcgcgaaatgcgtcagatggaaggggcatggctgggcagcgatctggttgaccagggtaaagagcgtctgaaccgtctcggttacttcgaaacggtggataccgatacccagcgtattccgggcagcccggatcaggtggacgtcgtttataaagttaaagagcgtaacaccggtagcttcaacttcggtgtcggctacggtacggaaagcggcgttagcttccaggtcggcgtgcagcaggataactggttaggcaccggctattccgttggcatcaacggcacgaaaaacgattaccagacctactctgagttctcgatcaccaacccgtacttcaccgttgatggtgtgagtctgggcggtcgtatcttctataacgactttgaagcggatgacgctgacctctcctcgtataccaacaagagctatggcgttgacggtacactgggcttcccgatcaacgagtacaacacgttgcgtctgggcttaggttatgtgcataacgatttgtccaatatggaacctcaggtcgccatgtggcgttatcttgactccatcggccagagcgccagtacgcaggatgatgacaacggcttcgcggccgatgacttcacctttaactatggctggacctataacagactcgaccgcggctacttcccgacggaaggttcgcgcgtcaacctgaacggtaaagtcacggtgccaggctccgataacgagttctacaaagtcacgctggatactgcttcatacttcccgattgatgatgaccacaagtgggtcgttctgggtcgtaccaagtggggttacggcgatggcctgggcggcaaagagatgccgttctatgagaacttctatgccggtggctccagcagcgtacgtggcttccagtccaataacattggtccgaaagcggtgtactacggcggtaacggccaggataactgtgataacaacgtagcaggctctgtctgtaactctgatgatgctgtgggcggtaacgccatgggcgtcgccagcctggaattcatcacgccgacgccgttcatcagcgacaagtatgctaactcggttcgtacgtccttcttctgggatgcaggtactgtctgggatacgaactgggaagacaccgcgcagatgaaagcgattggtgtgcctgattacagtgacccgagcaatattcgtatgtctgccggtatcgcactacaatggatgtctccattggggccgttggtcttctcttacgcccagccgtttaagaagtacgatggcgacaaagcagagcagttccagtttaacatcggtaaaacctggtaactggtctttgcaaaggactgcaatagcagtgtagcgtgacacggtttcgccctgtcacgcaaagaatggtacctgcgggtacatttgggatggtaaggagtttacagtgaaaaagtggttattagcggcaggtctcggtttagcgatggcaacgtccgcgcaggcagcagacaaaattgcaatcgtgaacatgggcaacctgttccagcaggtggcacagacaactggcgtttccaaaacgctggaaaatgagttcaaaggccgtgccggtgaacttcagaaaatggaaaccgatctgcagtctaaaatgcagcgtttgcagcgtgatggttctaccatgaaatcatccgatcgcagcaagctggaaaaagacgtaatggcacagcgccagaccttctctcagaaagcacaagcttttgagcaggatcgtcagcgtcgttccaacgaagagcgcggcaaactggttaaccgtatccaggcggctgtgaagaaagtggctgacgaccagagcatcgatctggtggttgacgcaaataccgttgcttacaacagcagtgatgtgaaagacattaccgctgatgtgctgaaacaggttaaataagtaatgccttcaattcgactgtctgaattagcagggcagttggatgcagaattacacggtgatggcgatatcgtcatcaccggcgttgcgtccatgcagtctgctaaagcaggtcaaattactttcatggtaaatccaaaataccgtgaacacctggccgcctgccaggcgtctgccgttgtcatgacgcaggacgatctcccttacgccaaaagcgcagcgctggtagtgaagaatccctacctgacttacgcgcgtatggctcaaattcttgattccacgccgcagccggcacagaacattgcgcaaagcgcggtgattgatgcctcggcaacactgggtcaaaacctctctattggcgcgaacgccgttatcgaatctgatgtggtattaggcgataacgtagtgattggcgcgggttgcttcgtcgggaaaaagactaaaattggcgcaggctcgcgtttatgggccaacgttaccgtttaccatgagattgagatcggtgagaattgcctgatccagtccgggacggtgatcggcgcggacggttttggctatgctaacgatcgcggcaactgggttaagatcccgcagctcggccgggtgatcattggctctcgcgtagagatcggcgcctgtaccactatcgatcgtggggcgctggatgacaccattatcggtaatggcgtcattattgataatcagtgccagattgcacataacgttgtgattggcgacaataccgcagttgcgggtggcgtcatcatggcgggcagcctgaaaattggccgttactgtatgattggcggtgccagcgtgattaacggtcatatggaaatctgcgacaaagtcaccgtaacgggtatgggcatggtgatgcgtccgattactgaaccgggcgtatactcctccggtatcccgctgcaacccaacaaagtgtggcgcaaaacagcagcactggtgatgaacattgatgatatgagcaagcgtcttaaagccgttgagcgcaaggtcaatcaacaagactaataattcatccgttttacgcccaaacttcccggcctgacggcattagcttgccgcgggccgtgttattattgccattaagtatatttagacaggaagagtattttgactactgacactcatactctgcacattgaagagattttagagcttctgccgcaccgttacccgttcttgctggtcgatcgtgtgctggattttgaagaaggtcgttttctgcgcgcagtaaaaaatgtttcggttaacgagccatttttccaggggcatttccctggcaaacctattttcccgggcgtcctgatcctggaagccatggcgcaggccaccggtattctggcgtttaaaagcgttggtaaactggagccaggcgagctgtattactttgcgggcatcgatgaagcgcgctttaagcgcccggttgtccctggtgatcagatgatcatggaagtgacgttcgaaaaaacgcgtcgcggcctgacacgctttaaaggcgtggctacggttgacggcaaagttgtttgtgaagctactatgatgtgtgcacgtagccgggaggcctgatacgtgattgataaatccgcctttattcatcctaccgccattgtggaagacggtgccgtcatcggcgctaacgttcatattggaccgttttgtcttgttggaccccatgttgaaattggtgagggtaccgtactgaagtctcatgtcgtgattaatggccacactgttattggccgtgacaacgagatatatcagttcgccactatcggtgaagcaaaccaggatttgaaatacgctggtgagccgacccgtgtagaagtgggcgatcgtaaccgcattcgcgaaagcgtcaccattcaccgtggaaccgttcagggtggtggattgacgaaggtgggcagcgacaacttactgatggttaacgcgcacgttgcgcatgactgtaccgtcgggaatcgctgtattcttgctaacaatgcaacgcttgcgggccacgtttcggttgatgattttgcaatcatcggcggcatgacggctgtgcatcagttctgcattattggcgctcacgttatggtcggcggttgctccggtgtggcgcaggacgtcccgccgtatgtaattgcccagggtaaccacgccacgccgttcggtgtcaacatcgaagggctgaagcgccgtggttacagcaaagaggcgctgtttgctatccgtaacgcttacaaactgctgtaccgtagtggtaagacgctggaagaagcgaagccggaaatcgccgcactggcggaacagcatccggaagtgaaggcgttcaccgagttcttcgaacgctcaacccgtggtctgatccgttaatgtctggtcgtcctcttacgatagccctggtcgccggagaaacctccggcgatattcttggcgcaggtcttattaaagcgctgaaagcacgccaccctgacgcgcgttttgttggtgtcgcggggccgcgtatgcaggccgaaggttgtgaagcctggtacgagatggaagagctggcggtgatgggcatcgtggaggtgctgggccgtttgcgtcgtctgctgcatattcgcgccgatctcacccgccgttttaccgatctcaagcctgatgtgtttgtcggcattgatgcgccggacttcaacatcacgctggaaggcaatcttaaaaagcatgggatcaaaacgatccattacgtcagcccgtccgtctgggcctggcgccaaaaacgcgttttcaaaatcggcagatccaccaatctggtgctggcttttctgcctttcgaaaaagcgttttatgaccggtttaacgtgccgtgtcgctttatcggccataccatggcggacgcgatgccgctggatcccgataaaaacgcggcacgcgatacgctgggcattgctcacgatgtgcattgtctggcgcttttgcctggcagccgcggcgcggaagtggaaatgctcagcgcagatttcctgaaaaccgcacagattctgcgtagccactatccggatctggaagtggtggtgccgctggttaacgcgaaacgccgcgagcagtttgagcgtatcaaagcggatgtcgcgccggatttgcgcgtgcatctgctggatggcatgggtcgtgaggcgatggtcgccagcgatgccgcgcttctggcgtccggcaccgccgcgctggagtgcatgctggcgaaatgcccgatggtggtgggctatcgtatgaagccgttcaccttctggatcgccaaacgcctggtaaaaaccgactacgtgtcgctgccgaatctgctggccgggcgtgagctggtgaaagaattattacaggaagagtgccagccgcaggcgttagccgacgcgctgttgcccctgcttgccaatggcaaaaccagccatgccatgcatgagacattccgcgaactgcatcagcagatccgttgcaatgccgatgaacaagcagccgatgcggtgctggagttagcgcaatgatggaatttatctatccgcacacccgattagtggccggtgtggatgaagttggccgtggcccgctggtcggagccgtggttaccgcggcggtgatcctcgatccggcgcgcccgattgtgggtctgaatgactcgaaaaaattatcggaaaagcgccgtctggcgctgtttgatgaaatcaaagacaaggcgctgagctggagtctgggccgtgccgaaccgcatgaaattgacgagctgaatattctgcacgccaccatgctggcgatgcagcgtgccgtggccgggctgcatatcgccccggaatatgtcctgattgatggcaaccgctgtccggcgctgccgatgccctccatggcggtcgtcaaaggcgacagccgggtcgcagaaatcagcgcggcgtctattattgccaaagtgacgcgcgatgcggaaatggcggcgctggatctgacttttcctcaatatggctttgcccggcacaaagggtatccgacagccttccatctggagcggctggcgatgcacggtgcgacagagcatcaccggcgtagctttgcgcccgtaaaacgcgcactgggactggtgtcctgatccttgcagcacaataagtaaaccggaagctaaaatggctgaaccacgtttcgtacacctgcgggtgcacagcgactattccatgatcgatgggctggcaaagaccgggccgctggtgaaaaaggcggcctcgctgggcatgcctgcgctggcgatcaccgattttaccaacctctgcggtctggttaagttctacgggacgggccatggcgcggggctgaagcccattgtcggcgcagattttcatgtgcagagcgacatcatgggcgacgagctgacgcagatcaccgtgctggccgccaataacaacggctatcagaacctgacgctgctgatctcccgcgcttaccagcgtggctatggcgcgcaggggccgtggatcgatcgcgactggctggcggagctgggcgatggcctgatcctgctgtccggcgggcgcatgggcgacgtcggtcgtagcctgctgcgcggcaacagcgcgctggtcgatcagtgcgtctcgttctacgaaacgcacttcccggaccgtttcttcctcgaactgattcgcaccggccgcccggacgaagagaactatttacatgcggccgtcgaactggcgcaggcccgcggcctgccggtcgttgccactaacgacgtacgctttatcgataccggtgacttcgacgcgcacgaaatccgtgtggccatccacgacggctttaccctcgacgatcccaaacgcccgcgtaactattcgccgcagcagtacctgcgtaccgaagacgaaatggtggagctgtttgcggatctgccggaagctctgcaaaacagcgtcgaaattgccaaacgctgtaacgtcaccgtgcgcctcggcgaatacttcctgccgcagttcccgaccggtgacatgagcaccgaagatttcctgatcctgaaatcaaaagaggggctggaagagcgtctggaattcctcttcccggacccggcggtgcgcgcagagaaacgcccggaatatgacgagcgcctggacattgaactccaggtgatcaaccagatggggttccctggctacttcctcatcgtgatggaatttatccagtggtcgaaggataacggcgtaccggtagggccgggtcgcggctcgggcgcgggttcgctggtggcctatgcgctgaaaatcaccgacctcgatccgctggaattcgacctgctgttcgaacgcttccttaacccggagcgtgtgtccatgcctgacttcgacgttgacttctgcatggagaaacgcgatcaggtaattgaacacgtggccgatatgtatggccgcgacgcggtatcgcagattattacctttggtacgatggcggcgaaagcggtgatccgcgacgtgggccgcgtactggggcatccgtacggctttgtcgatcgtatctcaaaactcatcccgcccgatccggggatgacgctggcgaaagcctttgaagccgagccgcagctgccggaaatctacgaggctgacgaagaagtcaaagcgctgattgatatggcgcgtaagctggaaggcgtaacgcgtaacgccggtaaacatgcgggcggcgtggtgatcgcgccgacgaaaattaccgactttgcgccgctgtattgcgatgaatcaggccagcatccggtcacccagttcgacaagaacgacgtggaatatgccggtctggtgaagttcgacttccttggtttgcgaacgcttactatcatcgactgggcgctgaagatgatcaacccgcgccgggccaaacagggcctggagccgattgatattgcggcgatcccgcttgatgacaagaaaagctttgatatgctgcagcgctcggaaacgaccgccgtgttccagcttgaatcgcgcggcatgaaggatctgatcaagcgtctgcagccagactgcttcgaagatatgatcgcgctggtggccctgttccgtcctggcccccttcagtccggcatggtggataactttatcgaccgtaagcacgggcgcgaagagatctcctatccggatgtgcagtggcagcacgaatgcctgaaaccggtactggagccaacctacggcattatcctgtaccaggaacaggtgatgcagatcgcgcaggagctttccggctataccctggggggcgcggacatgctgcgtcgtgcgatgggtaagaaaaagcccgaagagatggccaagcagcgttctgtctttgaagagggcgcgagaaagaacggcatcgacggcgaactggcgattaaaattttcgatctggtggaaaaattcgctggctatggctttaacaaatcgcactccgccgcctacgcgctggtgtcttaccagacgctgtggctgaaagcgcactatccggctgagtttatggcggcggtgatgaccgccgatatggacaacactgagaaggtggtggggctggtggatgagtgctggcgcatggggcttaagatcctgccgccggacattaactccgggctgtatcatttccacgttaacgatgacggtgaaattgtctatggcatcggcgcgatcaaaggcgtgggtgaaggcccgattgaagccattctcgaagcgcgtaataaagacggctatttccgcgagctgtttgatttatgcgcccgtaccgacaccaaaaagcttaaccgccgggtgctggaaaaactgattatgtccggggctttcgaccgcctcggaccgcaccgtgcggcgctgatgaatgcgctgggcgatgcgctgaaagccgccgaccagcatgcgaaagccgaggctatcggccaggctgacatgtttggcgtgctggcagaagagccggagcaggtggagcagtcctatgccagctgccagccgtggccggaacaggtggtgctggatggcgagcgtgaaaccctgggtctgtatctgacagggcacccgatcactcagtacctgaaagaaattgagcggtatgtcggcggcaatcgcctgaaagacatgcacccgacggaacgtgggaaagtcaccacggcggcggggctcgtcattgctgcgcgggtaatggtcaccaagcgcggcaatcgtatcggcatctgtacgctggatgaccgttccggacgcctggaggtgatgttattcaccgacgcgctggataaatatcagcatttgctggaaaaagaccgcatacttatcgtcagcggacaggtcagctttgatgacttcagcggcgggcttaaaatgactgcccgcgaagtcatggacattgacgaagcccgggaaaaatatgctcgcgggcttgctatctcgctgacggacaggcaaattgatgaccagcttttaaaccgactccgtcagtctctggaaccccatcgttcggggaccattccagtacatctctactatcagagggcggatgcacgtgcgcggttgcgcttcggtgcaacgtggcgtgtctctccgagcgatcgtttactcaacgatctgcgtggccttattggttcggagcaggtggaactagagtttgactaatacaggaatactatgagtctgaatttccttgatttcgaacagccgattgctgagctggaagcgaaaatcgattccctgacggccgtaagccgccaggatgagaaactggatattaacatcgacgaagaagtgcatcgtctgcgtgaaaagagcgtagaactgacgcgcaaaatctttgccgatctcggcgcatggcaggtcgcgcaactggcgcgtcacccgcagcgtccgtacaccctggattatgtccgcctggcatttgatgaattcgacgagctggcaggtgaccgtgcttacgctgacgataaagccattgttggcgggatcgcgcgtctggatggccgtccggtgatgatcattggtcatcagaaggggcgcgaaaccaaagagaaaatccgtcgtaacttcggcatgcccgctccggaaggctatcgcaaagcgctgcgtctgatggaaatggcagagcgttttaacatgccgatcattacctttatcgacacccccggcgcttatccaggcgtcggcgcggaagagcgcggtcagtctgaagccatcgcccgcaacctgcgtgaaatgtcgcgtctgaacgtacctgtcatctgcaccgtcattggtgagggtggttccggcggcgcgctggcgatcggcgttggcgataaagttaatatgctgcagtacagcacctattccgttatctctccggaaggttgtgcgtccattctgtggaaaagcgccgacaaagcgccgctggccgcggatgccatgggcattatcgcgccgcgcctgaaagagctgaagctgatcgacagcgtgatcccggaaccgctgggcggcgcgcaccgtaacccggaagcgatggctgcctccctgaaagcgcaactgctggacgatctggcggatctcgatgtgctgagcaaagaagatctgcgtaaccgtcgttaccagcgtctgatgagctacggctacgcctgatacgcgtcatgattctgaaaagccacactatagtgtggctttttttatacctgccgtttacctcaactatcattagcggaggttttttgcaggagtgacgcgtgaatattattgccattatgggaacgcatggcgttttttataaagatgaacctataaacgaactggtcatcgcactggagaaacaagggtttaaaatcatcttcccgcagaacagcgccgatctgctgaagtttattgagcataacccgcgcatctgcggcgtgatttttgactgggacgagtacggcattgagctgtgcagcgatattaatcagctcaacgaatatctgccgctgtatgcttttatcaatacccactcaacgctcgacgtcagcgcccacgatatgcgcatggcgctgtggttctttgaatatgcgctggatgtcgctgacggcatcgccacccgcattgagcagtacacccgcgaatatcttgataacatcacgccgccttttacccgcgcgctctacacctatgtgaaagaggggaaatacaccttttgcacgccagggcatatggcgggaacggcgtatcaaaaaagtccggtgggctgcctgttttatgacttctttggcggtaatacgctgaaagcggatgtctcgatttccgtcactgagctgggctcgctgctcgatcataccggtccgcatctggaagcggaggagtacatcgcccgcacctttggcgccgagcagagttatatggtgaccaacggcacctcgacgtccaacaaaatcgtcggcatgtacgccgcgcccaccggcagcacgctgctgattgaccgcaactgccataaatctctcgcccatctgctgatgatgagcgatgtcgtgccgctgtggctgaagccggggcgtaacgcgctgggtattctgggcggcattccccgtcgtgaattcagccatgcaagcattgagcaaaaagtggcggccaccagcggggcggcctggccggtgcatgcggtgatcaccaactccacctatgacgggctgctgtacaacaccaactggatcaagcagaccctcgatgtaccctcgatccattttgattccgcctgggtgccttacactaatttccatcccatctatgccggaaagagcggcatgagcggtgaacgcgtgccggggaaagtcttcttcgaaacccagtcgacgcataaaatgctggcagcgttttcgcaggcctcgctgatccacattaaaggcgagtacgacgaggagacgtttaacgaagcctatatgatgcataccaccacctcgccgagctatccgctggtggcctctattgaaacggcggcggcaatgctgcgcggcaatcccggcaaacggctgatcaaccgttccgttgagcgggcgctgcatttccgtaaagaggtgcagcggctgaaggatgaggccgacggctggttctttgacatctggcagccggaggaaatcgacgaggctgactgctggccggtggcgccgggggagagctggcacggattccgcgacgcggacgccgatcatatgttcctcgatccggtcaaagtgaccattctcacgccgggcatggatgagcagggcaacatgagcgatgaagggatcccggcggcgctggtggcgaaattccttgatgagcgtggcgtggtggtggaaaaaaccgggccttacaatctgctgttcctgttcagtatcggcatcgacaaaacgcgggcgatgggactgctgcgcgggctgatggagttcaaacgcgcctacgatctgaatctccgggtgaaaaatatgctgccggatctctacgcggaagatcccgatttttatcgcaatatgcgtattcaggatctggcgcagggcattcatcaactgatccgccagcacgatctgccgcgcctgatgttacaggcctttgacgtgctgcccaccatgcgtatgaccccgcaccaggcctggcagcagcaggtgaaaggcgaggtggagacggtggcgctggagaagattgtcgatcgcgtgtcggccaatatgatcctgccttatccgccgggcgtgccgctgctgatgccgggggagatgatcacagccagaagccgcgccgtgctcgatttcctgcttatgctctgcgccattggccgtcattatcccggctttgaaaccgacattcacggggcgaagcgcgatgaagagggcatctaccgggtacgagtcctaaaacagggctgaccccttgcagagcgtcgcgggcgatcgtaacgtgcagggatcggaaaaaggagacagcatgctcggcttaaaacaggttcaccatatcgcgatcatcgcgagcgactatacccgcagtaagacattttactgcgacattctgggctttagcttacaaagtgaagcgtaccgtgcggagcgggactcctggaaaggcgatctggcgctgaacggtcagtatgtgatcgagctgttttcatttccgtttccgccggcgcgtccgagccatccggaagcctgcggtttacgccacctggcgttcagcgtggatgacgttgaagcagcgatcgcgcatctggaagcccataacgtgacctgcgagccggtacgtgtcgatccctttaccggcaaacgttttaccttctttaacgatcccgacggtctgccgctggaactttaccagcagtaacgcttgccactgtggaagatgcccggtaacgtgccgccatcttcctttttaaacgatcatcatgaccatttccgctcttgcacagtcccttgaaccgcatcgccagttgctggtggggttcagcggcggcctcgattcaaccgtactgctgcaccagctggtgtgctggcgcgaacagcagccggaggtatcactgcgcgcgatccacgtccatcacggtctgaacgcccgcgcggatgagtgggtggaacagtgccaggcgctttgcggacagtggcaggtaccgcttaccgtcgtgcgcgtgactttaaaccaggccggggaaagtattgaagcgcaggcgcggcaggcgcgctatcaggcttttcgcgaggcgctgttgcccggcgaagtgctgcttaccgcccagcatctggacgatcagagcgaaacttttctgctggcgttaaagcgcggcagcggcccggcaggactggcgtcgatgcccgcctctctgcctttcggcgatacgctgttgctgcgcccgctgctctgtacccgccggacggcgctggaagcctgggcgcagcagcacgcgctgcgctggatcgaagatgacagcaatcaggatgataaatacgaccgcaactttttacgtctgcatattttgccgcgtcttaacgcccgctggccgcattttgccgacgcggtggcgcgcagcgcagcactatgcggcgagcaggagcagctgcttgacgagctactggcggaagagctggccgcgctgaccaacgaagcgggtgcgctgcatatcaccccgctgatgacgaaaagcgccgtccgacgcgcagctatcctgcgccgctggctggcgcagcagggcgcggctatgccatcacgtgaccggctggcgcgcatctggcaggaagtggcgctggcgcgcgacgatgccacccccggcctgacgctgggcgatggagagatccgtcgctatcagggactgctctggtgggtaaaggtgccgcaaagtcagcgcgacacacaaatcggctgggatgatccctttcagccgctggccttacccgcgggcctgggagagttgcagcttataacaggcggcgagatacgtgccccgcgcgccggtgaacgggcgacagtgcgtttttacgcgcccggaatgctgcatatccttggtcgtgccggggggcgtaagctgaaaaaaatctggcaggagctgggagtgccgccctggcagcgggatagcacgccaattctgttctatgatgaaacgccgattgccgcggcggggcagtttataacgcgggacggactggcggagggggaagccggttttacgttgcggtggaaaagataacgggcagccaggctgcccgcttgattgactcaggactcgctcaccacaacggtgccgatttgcggatggctgaagctggctatcctgtcgaggcggagttcccgcgtcgtgccagcggcatcagcgaccaggtattcaacattcttacgcatgaccaaatcgctggcttttgcctgcaagacttcgccgtctttgagttccagcgtcagtaaaagatgatgctggcaggcgagctcgaggttgtcatagtcatcacaattgatgggttgataagtatcattcattgacataatcgctcaccagtaagttcgcggcagcataagccgccttttccctgacagactccgaagtcgcaccatctgatgccacttcattgagtacgtttaacacgcagcccagcgcatcggggatataccctaagtctccgctggcgatctccgcataccgcttgcgtattaactcacagtaattttccacatgtcctcctgtcagtgtgctgacttcaccatgggatgtaagtttaagcctacgaagataaactctgtttagcaaggtgactataccacactcattggcgcattatcagcgtagtaagcggtcactactttaagagtaaacagcgctttatcccttaattcgctacaatggggataattttgtgcaggagtggtgtcatggcgttaaaagcgacaatttataaagcgacggtcaatgtggccgatctggatcgtaatcagtttatggatgctacgctcacgctggcccgccatccttctgaaacccaggagcgcatgatgctgcgcctgctggcgtggatcaaatatgctgacgagcggttacagttctcccgtggcctgagcgccgaagatgagccggaagcctggcggcataacgatcacatgggcatcgacctgtggatcgagctgggcctgccggatgagaaacggatcaaaaaagcctgcacccaggccaaagaagtggcgttgtttacctataacagccgttctgcgcaaatctggtggcagcaaaatcagaccaggcttgcgacctacagcaacctgagcatctggtatctggatgatgaacagctggcgaagctcagcgattttgccgggcgtaccatgaccctgcaggccaccattcaggagggggcgatctggctgtctgatgcgcagaataacctggagatccatctgaccacctggcaacaaccggcatgatcacgctgtcatcgaatgtcactatcccggacaacgaactggagatcaccgcgatccgttctcagggcgcgggcgggcaaaacgtcaataaaacctccacggccattcacctgcgtttcgacattcgcgcctccagcctgccggagttctacaaagagcgcctgctggcggcgacgcaccatttgatcaccgcggaaggcgtggtgattattaaggcgcaggagtaccgcagtcaggagatgaaccgtgaagcggcgctggcgcggctggaagcgttgataagagaattaaccgtggtacagaaaagccgacgtccgacgcggcccacgcgcgcgtccaaagagcggcgtctggcgggcaaagcgcagaaatcgactgttaaatccctgcgcggcaaagttcgcccataaaaaaagcccggtcaggttaacgtgaccgggctgtcgtttgccgggtggcgactgcgtcttacccggcctgcatgagcttatgtaggcccggcaagcctgcgccgccgggcaataataatcctcagcctttaatcgccttgaccagatacggcaggatgtccccggttttgatcatctgcttctcgccgctacgacgatatttgtactcaatttcgtcgctgtcgaggttacggtcgccgataacgatagtgtgcggaatgccgatcagctccatgtctgcaaacatcacgcccggacgctctttacgatcatccatcagcacttcaatgccctgcgcacgcagctcgctgtagagcttctctgccagttcctgcacgcggaaagatttgtgcatattcatcggcagaatggcgacctggaaaggcgcaatggcatcaggccagacgataccgcgttcgtcgtggttctgctcgatggccgcagccaccacacgggtcacaccgataccgtagcaacccatggtcagcgtaacgttacgaccatcttcaccctgtacggaggctttcagcgcttcggagtacttggtacccagctggaaaatatgacccacttcgataccgcgtttgatcaacagcgtaccctgaccgtccgggctcggatcgccggccaccacgttacgcagatccgcgacttctggcgtcgccacatcgcgatcccagttgatgccaaagtagtgtttaccgtcgatgttcgcgcctgcggagaaatcactcatcgcggcaacggtacggtcgataactaccgggatcggcaggttaaccggacccagcgagccagggcctgctttaaccagcgcgcggatctcttcttcgctggcgaaggtcagcgggctggccacctgcggcagtttttcggctttgatttcgttcagttcgtgatcgccacgcaccagcagggcaaccagcggatatgcgctgtcttcgaccgcttttaccagcagggttttcacggttttctcgatgggcagattgaactgctcaaccagctcggcgatggttttcgcgttcggcgtatcaaccagcgtcatttcctgcgtcgcggcggcacgcggctctttcggggccagcgcttcggcaaattcaatgttggccgcgaaatcggagctgtcggagaatatcacatcgtcttcgccgctctgcgccagcacctggaattcgtgcgaagcgctaccgccgattgagccggtgtcagcctgtaccgcgcggaagtccagacccatacggctgaagattttgctgtaggccgcatacatggcgtcgtaggtttcctgcagggattcctgagaggtatggaaagagtaagcatctttcatcaggaattcacgggagcgcatcacgccgaaacgcgggcgcacttcgtcacggaatttagtctggatctggaagaagttcagcggcagctgtttataggagctgagctcgttacggatcaggtcggtgatcacttcttcatgcgtcgggccgagcacgaacggacgttcgccacgatcgacaaaacgcagcagttccgggccatactgctcccagcggccgctttccacccacagatcggcgggctgaacaaccggcatggacacctcgatcgcaccggcgttgttcatctcttcacgcacgatgttttcgacttttttcagcacgcgcaggccggtcggcagccaggtgtataacccggaggccagcttgcggatcatcccggcgcgcagcatcaactggtggctgatgacttcggcatcggcaggtgtctccttcagagtggagagcagatattggctagtacgcatgtagttacggttccatttggacgatgagcacaggctcaaaacgagcctgacacaaaaaaagtggtttagtttatcagcctggcaatgatgccaaaagagagcgcactaaaattagcgcgattccagcgcaaagacctcaaatcccgacggcgttacgcgccagcgtacgttaaagtccagcaaccatacggcataggttttgcccatctcttcttctttgcggtaggccgggcgcggatcctgggccagtacatcgatgatgaactgtcgcagggcagggtagcgctgctccagcgccgttaactgccgggcaatgtcttcggtaaaaaacaccggcatattcgcctgcggcgcaagctgggcatagctggctttcgcgtcgggtaaggcttcggcgaacggcagatagggcttgatgtcgatcactggcgtgccgtcgaccagatccagactgccgagctcaagaatgacctgatctttctggcagcgaatgccttttaattcaaccagcgacatgccgaccggattcgggcggaatgttgagcgcgtggcaaacacgcccattcgggcattgccgccgagacggggagggcgcaccgttggccgccagcccccttccatcgtctgatggaaaacaaacagcacccacagatggctgaacgcctcaaggccgcgtacagcatcggcctgattgtatggggcagtaagatgaagttcgccgcgactgtttaccagccctggctggcgcggtacggcaaacttctctttatagggcgaacggataacgcctatttgctcaaacgaaaaggcactcattttgccgtaatgttaagcgcagtaccgatgcatactgcctgacgatagcagcccggcgtgccgctggtaacttcacagctgtgctgtaacacggcgttggcgcgcaatttagaagcgttaatctgcatgcgtttacgtgcggtagggatattcggcggggagtcctgattagacgcctggcaggagtcgccggacacttcacccagatcgcggaacggtttaccaaccagctcttcggcattggtgataattcttaccggggccgcgcgcggcgcttttggtttttccggctcggtttttgtggttgtagcggtgcccctggccggttcgacgggagatctgcttagcatggaacagccgctcagcatgagtgccagtaaacagatcggtaaagcgcgcataatatatcctcagtaaataatggcattaccaggtattgaaacaggagagtacagaaatgacaaggcgggcttacgcccgccttgaaggatattacagaaaaaagcgattaccagcctttaaccgcgccgccgttaaagactttgttggcttcctggtaaacttcatcagactggtaagcctggatgaatttcttcacgttttccgcatctttgttgtcttcgcgggatacgagcaggttgacgtacggggagtctttatcttcaacgaagataccgtctttcgccggcgtcaggttgatctggctggcgtaagtggtgttgatgacggccagcgcaatctgcgcgtcgtctaacgagcgcggtaactgcggcgcttccagttcaacaatcttcaggtttttcgggttttccaccacgtccagcacggtcggcagcagaccgacgccatctttcagtttgatcagaccctgtttttgcagcagcagcagggaacggcccaggttagtcggatcgttcggaacggcaacctgcgcgccttcctgcaactcatcaatggatttgatttttttggagtagccggcgatcgggtaaacgaaggtgttcgccacggaggtcagcttatagccgcgatctttgatctgctgatccagataaggtttgtgctggaaggcgttcaggtcgatatcgcctttgctcagcgcttcgttcggcagcacgtaatcgttaaaggtcaccagttccacgtccagaccgtatttctctttcgccactttcgcggcggtttccgctacctgctgctcagcgccgacgatcacgcccactttaatgtggttgggatctttttcgtcctgaccgcaacccacgagggccagagaaccaatcagggcacccactgccgcaaaggtcttgaatttaaacgccatgctatttccttaactctcagagtcgattgtgttgtttataacgttatttgtgagtgacagcccggacgatacgatcgcccgagaactggatcagataaaccagcaccaccagcagtaccagcaccgtattcatcacggtggcgttatagccgatgtaaccgtactgatagccaatttgtcccaggccaccggcacccacagcaccgcccatggcggaataacccacaagggtgatcagggtaatggtagccgcgttcaccagaccagcaagggcttccggcagcaggaccttacgaatgatctgcatcggcgtggcacccatcgcgcgtgaggcttcgataagtccggtcgggatctccagtaaggcgttctcaaccatacgggcaataaagggcgctgcgcccacggtcagcggtacgatagccgcctgcaagccgatggaggtgcccacaatcacgcgcgtgaaggggatcatccagaccagcaaaataatgaacggaatggagcggaaaatattcaccagcgcggaaatgctgcgatacagctttgcgttctcgctgatctgaccgggacgggtgacgtacagcagtacgcctaccggcagcccgatcacaaaaccaaagaagccggagacaaaggtcatcgccagcgtctcccagacgccccgcgccagtaaccacatcattggctcagacataacccagcacctctacttttacatggtgttcctgcagccacgcaatggcggcttgcgtatcctgttgtgtgccgtgcatttccgtcagcatgatgccgaacttcacgccaccggcgtaatccatctgcgcgctgataatgttgttgttcacattaaaacggcgtgcggtttcagaaagcaggggagcatccaccgactgaccggtaaattccatacgcagcatcggcacgctggtggcgcccggctctgccgtcatgcgctgctgataatcttccggaatgtccagatgcagcgtggactgaataaactgttgcgccagcggcgttttcggatgcgagaacacttcgctgacggtgtcctgctcgataagctcgccgttgctgatcacggccacgcagtcgcagatacgtttcaccacgtccatttcatgcgtaataaggaggatggttaaaccaagacggcggttaatatctttgagcagttcgaggatggagcgggtcgttgctggatccagcgcgctggtggcctcatcacacaacaatactttgggattgctggccagcgcacgggcaatggccacgcgttgtttttgaccgccggaaagattcgccggatagctgtcatgcttatcgctcaggcccactaactccagcagctcggtgacgcggcgtttgatttcagcggcgggggtgttgtccagctccagcggtaatgcgacgttgcccgccacggtgcgcgaagcaagcaggttaaaatgctggaagatcatgccgatctgacgacgggctttggttaactgggattcggtcagggcagttaaatcctgaccgtcaaccagcacgctgccctgcgtcggacgctccagcaggtttacgcagcggattaaggtacttttccccgcacctgaagcgccaatgacgccataaatttgaccggcagggacatgcaggctgacattgttcagcgcctgtatggtgcggttcccctgctggaagactttggtgatattcgaaagtttaatcattagattatttttatcgtttaaaagttagccgtggcattttgttctgccggatacgggcgatgaccgtaaacaaaacggatgttaaggcatccagacgtctatttcaatgtaactctgtatgatgagcactttcttgcgttcagaaacatgagatactagcgccataggtcttatataaaggagcaaaccggtggcacagtcagtacccgcaatttttctcgatcgtgatggcacgattaatgtcgatcatggttatgtccatgagagtgataacttcgaatttatcgatggcgtaatagatgccatgcgtgaattgaaagcaatgggctatgcgctggttgtcgtcaccaatcagtccggcatcgctcgcggtaagttcagcgaagcgcagttcgaaacgctgaccgaatggatggactggtcgctggcggatcgcggcgtcgacctggatggcatctattactgcccgcatcatccggaaggaagcgtggaagagttccgccaggtttgtgattgccgtaaaccgcagccgggaatgcttatctcagcgcgcgactttttgcacattgatatggcggcttcttatatggttggcgacaaactggaagatatgcaggctgccgctgccgcaggtgtgggtcataaagtattagtgcgcacgggtaaacccgtcacgcctgaagcagaaaacgcagcagattgggtgataaatagccttgctgacctgcctgcggcaatcaaaaagcagtaaaaataagcgttatgatgaaaaggtgagcggttgaaacaaaaatgcagttttatgcttgtcatcccgtccggactccctataatgcgcctccatcgacacggcggatgtgaatcacttcacacaaacagccggttcggttgaagagaaaaaatcctgaaattgagggttgactctgaaagaggaaagcgtaatatacgccacctcgcgacagagcgctaaagcgcgtcgcaactgctctttaacaatttatcagacaatctgtgtgggcactcaaggacatggattcttaaacgtcttcggacgctaaatgaataccaagtctctggagtgaacatacgtaattcattacgaagtttaattcacgagcatcaaacttaaattgaagagtttgatcatggctcagattgaacgctggcggcaggccta

SEQ ID NO: 4 - DNA, 421561 bp, Enterobacter sp SA187
taggcctgccgccagcgttcaatctgagccatgatcaaactcttcaatttaagtttgatgctcgtgaattaaacttcgtaatgaattacgtatgttcactccagagacttggtattcatttagcgtctttcgacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaggaagaccttctgacccggtggcctgtaagccgttgttccgtgtcagtggaggcgcattatagggagttattccgggctgacaacccctaatttcaaaaaacttttcaagcgcgttttttttcatcaaagcgttgtaaaaagcatcatcatttggcgaatttgctctttttatcatcgacatcccccggcagatggcatactagaacgtaaaaatgagaaaaaggaatgcgacgaatgcctttaagcgcacaacagttagcggcacaaaagaacctttcttatgtactggctgaaaaactggcccaacggatcttaaccggtgagtatgcgcccggaagcatcctgcctgcagagatggaattaggcgaagcgttcggcgtgagccgtaccgccgtaagagaagcagtaaagaccctgactgcaaaaggcatggtgctgccgcgtcctcgcataggtacacgcgtgatgccgaaaagcagctggaacttccttgataaagaactgctctcctggtggatgaccgaagagaactttcaggaagtcattcagcacttcctggttctgcgcagcacccttgaacctcaggcatgccagctcgcagcccttcttggcagcgcagagcaaaaagcgcatttgaatacgctgatggatgagatggtgcaattaaagaagcatttccagcgcgagcgctggatagaagtggatatggcctggcatgaacatatctacgcgatgagcggcaatcccttcctcacctctttcgctgccctctttcattcggtgtaccacacctacttcacctctattacacaaaatgaagtggtaaagctcgaaaatcatcaggcgattgtggatgccattcaggaaagcgacgctcagggtgcctatgaggcctgccagctattgttgaacgctccccacccggctaaataacaggaattcgcatgacagagaaaaaagcgcgcagtatggcgggcctgccgtggatcgcggcaatggctttctttatgcaggcgctggatgcgaccattttgaacacggcactgccggcgatagcccagagcctgaaccgttccccattggcgatgcagtcggcgattatcagttacaccctgacggtcgctatgctgatcccggcgagcggctggctggcggaccgcttcggcacacgccgtgtctttatgctggccgtttcgctgttcaccctcggttcgctggcctgcgcgctgtcgagttcactcggtatgctggtcatcttccgggtagtgcaggggatcggaggcgcaatgatgatgccggtggcgcgtctggcgctgctgcgtgcatatccgcgcagtgaactgctgccggtgctgaacttcgtgaccatgcctggtctgataggcccgatcctcggcccggtactgggcggcgtgatggtgacctgggcgagctggcactggatattcctgatcaacattcccatcggtatcgccgggctgttttatgcccgtaaatatatgccgaacttcacgacgccacgccggggcttcgatatgcggggcttttttctgttcggcctgagcctggtgctgttttcctgcggcatggagctgtttggcgagaagattgtcgccagctggatcgccctgtcggtgatcgtcaccggccttttacttctgctggcttatatccgtcacgcccgccgacacccgacgccgctgattgcgctgccgatgtttaagacgcgtaccttttccgtcggcatcgccggtaatctggcgtcccgccttggaaccggatgcgtgccctttttaatgccgctgatgttacaggtcggctttggctatccggcgctgatcgcgggctgcattatggcccccaccgccatgggttctattctggcgaaatccgcggtgactcaggttctgcgccgctttggttatcgtaatacgctggttggcattacagtgattatcggcgtgatgatcgcccagttcgcgctgcaatccccctccatgccgctgtggatgctgatcctgccgctgtttgtgctggggatggcgatgtccacgcagtttaccgccatgaataccattacccttgccgatctgaatgatgagaacgccagcagcggtaacagcatgctggccgtgacgcagcagttatccatcagtctgggggtggcggtcagcgcggcggtgctgcgcttttatgaagggtttgagaacgcgaataccgtggagcagtttcactacacctttattaccatgggggtagtcacgctgatatccgcttccgtctttatgctgttaaaagccaaagacggtcgtaacctgattaaagagcggcacaaagcttaggcggagccgcgttccattaacaccggcgtcagttgcagacgctgctggaccagggtgggatcggtgatgcgatgcagtaacacatcgatagccagctcacccagttcatctttcggctgatggatggtggtcagcgggggcgtcatgtaacgcgccagctcaatatcatcgtagccaacaatcgccatatcctgcggcaccttcagtccggcctgatataacgcctggtacgcgccaaaggccatggcgtcgttaccgataaacaccgcctgcggacgcgctttttgcgccagcaggatctgcattgcctcatagccgccgccaaactcaaagttaccgacgatctcatcgccttcacgaatttcgaggcctgcgcgtgccatggcttcgcgatacccctccagacgtaaacgcgccggggttttatccagcggcccggtaatgcaggcgatacgggtatggcctttatcaatcaggtgctgcgttgccatatcaccgcccagcagcgagttatcctgaatgagatcgctgtaaccatcgaacggcgcccagtccatcatcaccgtcggaatggacgggtagcgctgcatgatttcctgcgagggctgatgggtttcggtgcacagcaacagtaagccatcgacgcgcttttgcatcagcgtctccagattactgttcatgcgctgttcatcgccttcggtattacacagcaccaggctgtagccacgctcaaagcagctgcgctcgacgccgcgcaccagctcggaatagaaagggttggtactggcggtgatcagcatgccgatagtacgggtctggttgatcttaaggctgcgcgccagcgccgaaggggcgtagttcaggcttttgatcgccgcgtccactttcgcggtgatcgcctcgctgacgaaccggtctttattaatgacgtgcgagacggtggaggtggacacgcccgccagtcgggcaacatctttcatggttgccatgagaggttacccctgctgcgccagaaaatcgtcgatctcactgcgccacggcacggaaggctgcgcccctttacgcgttaccgcgatggccgccgccgcatgggcgaaacggatcgcctgctcaagcggcttgttttccagcagcgcggtcatcagcgcgccgttaaaggtgtcaccggcagcgatagtatcaatggctttcactttaaagcccggaatgcgctggccttcgccgttaacgctggcccacacgccgcggctgccaagcgtaatgatgacggtttcgatgcctttgctatgcagcgcctgcgcggcgcgcgcggcatcgtcatccgtttccactttaatgccggtcagtttttccgcttcggtttcgtttggcgtgatcacatccaccagcgccagcagctcgtcagacagctcccgtgccggagccgggttgagcgccacgcgcgtgcggttctggtgagcgatttttgccgccgccagcacgctttccaccggcgactccagctgcatcagcagcgcggatgccgcggcgatacgatcgcgctgcgcttcaaccagcgccacagagagcgcagcgttagcgccagcatgaataccgatgacattctccccttcaccgttcacaaaaatcagcgccacgccggtggattcaccagtgatgacgctgaccggcgtaacatcaatgttgtcgctcgccagctgtgtacggacccgttcgccagtgtcgtcgtcgcccgtgcaggcgataaacgcaatatctgcgccgctgcgtccggcagcaaccgcctggttggcgcctttaccgccaaaagcgacctggtactggctgccggtgacggtttcacccggtgtcgggaaggattcaaggttgagaatgtgatcggcattaatactgccaaggacgatgagtttacctgccatgttcatagtttcatcctgtaaatgcgccgccctgagcggcgcgtgccctgcttttcttatgttctttttcctgccgccacacgcggcggcaggacaatcacattactgtttgataaccagtttcagatcaaccgggtatttcgcctgtactttctcgcctttgatcactttgtcagcggtttcaacacctttcgcgccgatttgctccggtaactgggcgatggtcgccgccagtttgccgtcgtttaccgctttttcaccgtctggcgtaccgtcaaaacccaccaccattacgtcagttttaccggcggtttgcagtgcgcgcagtgcgcccagcgccatttcatcgttctgcgcgaacaccgctttcacgtccgggtgcgcagtcagcaggttctgcataacgttcaggcctttggtgcggtcaaagtcagccggctggctggccagcacgtcgaatttgtgggccgcaacggcctgctggaagccttcgccacgctcacgcgccgcggaagtaccggcgataccctgcagttcgatcacttttgcgccttcaccggcttttttagcgatgtagtcgccagcgattttgccgcccagcacgttatcagaagcgatgtggctgaccacctcgcctttggcggccatacggtcgagggtgatcaccgggattttcgcctcgtttgccatcttcacggcattacctaccgcgtcagaatcggtcgggttgatcaacagcagtttggtgccacgtacggttaaatcctgaacgttcgccagctctttcgccgggttgttctgggaatccagcaccaccaggttgtagcccagtttatcggcttctttttgtgcgccgtctttcagggaaacgaagaacgggttgttcagggtggagaccaccagcgcgatggtgtctttcgccatcacattcgcgcttacggtcgcactcagtgctacagcagaaaccagggtagccagttttttcatgttcatattcagatgtcctgtaatgtcattgattactgttttttgttgtctaccaggaccgccagcaaaatcaccactgctttaacgatcatctggtaataggaggaaacacctagcaaattcaggccattattgaggaagcccagaatcaatgcgccgataagcgtgccgacaatccggcctttaccgcccgcaaggctcgttccccccagcaccaccgccgcgatggcatccagctcgtagccggtgcccgccgtcggttgggcggaggagagacgcgcaacttcaataatgcccgccagagaagccagaaggccgctcagcgaatacacgataatcttgattttattcacactgatgccggacagacgcgttgccgcttcgttaccgcccagcgcatagatataccgaccaagacgggtgtgatgcaacacataccatgcggcaaggaagacaaaccccatgatccacaccggcgccgggatccccagcggacgaccgataccgaaccagccaaacagatcggcgttttccgtaaagcccgtattcatgggactgccgttggtataaaccatggtcgcgccgcgcagcagcagcatcatcaccagcgtggcgataaaagcctgcacgcggcctttcgcgacgatcgccccggtcatggccccgatagccgcgcctaatgccagcgccgccgctacagccaccagcgcattcacttccatccccaccagcgaggcagccactgcgccggtcagcgccagtaacgaaccgacggacaggtcgatcccggaagtaagaatgaccagcgtcatccccaccgccataatggcgttaaccgacgtctgttgcaggatattgaacaggttattaacggtaaaaaagttcgggctaagggtggagacaatcgcaatcagcaccagcagggcaatcagcgatttttgttccatcagccacgctttgttgaaatagcggcgggtagaaacggtttgggtactcattgcctggactcctgcgtatcgcgatttagcttgccgacggcggccgccatcagcacttcctgggtggcctgttcgcgggtgaattctccgcccagatgcccttcatgcatcaccatgatgcggtcactcatgccgatgacttccggcatttccgacgacaccagaatgatgctcaacccttcagccttaaactgattgattaactgataaatttctttcttagcccccacgtccacaccgcgcgtgggttcgtccagaatcagcactttcggacgcgtcatcagcccgcgggcgatggcgaccttttgctggttcccgccggaaagcaggccaatcggctgctccattgacggcgttttgacgttaaacagacggacgaaatctcccaccgcctgctgttcatctttatgcttcaggcgaccaccggcgtgactgaaatagcgcagcgcggtaagcgacatgttttctttaaccgacatgcccagcaccagcccgtcgcgcttgcgatcttcggagatatacacgatgccgttcgccaggccatcctgcggtgagcgggtgaccacttcatggccatcgagggtgacataaccgctggtgcgcggcagcgcgccgtacagcactttcatcagttcagtacgtccggcgcccatcagccccgccacgcctaagatctcgcctttgcgcagcacgaaggagacgttatcaacgcccggcccgcacacggcatccactttcaggcgcacatcgccgggggctttatcaagatgcgggtactgctcttccagcttacgtcccaccatcatttcaatcagcgtatcttcactcagcgtcgacacatcccgctcggcgataaactgcccgtcgcggaataccgtcacgtcatcgcagatttcgaagatctctttcatgcggtgggaaatataaacaatgccgcgcccctgggatttcagctcgcgaatgacgcggaacagggagtcggtttcggtatcagtcagcgcatcggtcggctcatccataatgatgactttcgactcaaagctcagcactttggcgatttccaccatttgctgatcgccaatcgacagatcgcccaccagccggtcgcttttaaagcgcaggttgagtttcgcgagcaggacgttggcttcggcatacatctttttccagtcgatcttgccgaagcgattaacgaactcgcggcctaaaaagatgttttccgcaatggtgagctgcgggatcaggttcagttcctgatgaatgatgccgatcccggcttcctgggaagatttaggaccggtaaaggtggtttcctggccgagccacagcagtgaacctgcatcacgctgataaatgccggttaagactttcatcatcgtggatttacccgcgccgttttcgcccaccagcgccataacgcggccgggataaacgttaagcgcagcgccggacagggcttttacgccggggaacgctttatcgatccccttcagttgcagtaatgcgtccatggcagcctcagaatgtgacgccagcgcagagaatgatattcgcatacggggaacactccccgctgcgaatcaccgcctgactgtctgcggtttgttgtttaaacgtttcgtgtgaaacataacgaacgtctatggtgtttccctggtgttgttgcagttgctctatgtggcggagcaacgtttcgtggagttgcggattatgatctttaatttccgtcgcgagaatggccgcctcaacctgcatttccgtcgtcacgacctccagcacctgcataaaggagggcacgccctgagtcagcgccatatcaatgcgctgcgtgctatggggcaccggcaatccggcatcgcacacgaccagcgtatcagtatgtccaagacgggaaattaccgacgaaatgtcagaattcagtacagaccctttcttcatatttatctccactagcgaaacgtttcgctaaagtgagtttatgctgaagggtgtgcagaaaaccatcacgacgtaacggaattgtgatcgccgtcgaaacgtttcgctaagtcaaatggagaaggataatgccaggcaatatgccgggtggcgctgcgcttacccggcctacggtctgtaggcccgtgcaagcgaagcgccgccgggcggaggcgttcagagattaaatctcaacctgcgttcccagttcaatcacccggttaggcgggatttcaaactgatcgggtgcacgcagtgcgttacgttgcagtaacaaaaacagcttgccgcgaagacgcagataccacgggcgtttgccgaggatcagcgactcatgggacataaagaacgaggtttccatcatccggcagctcaggccttccagcccgcagcggtggaacacctcttccacgttgggaatttcacgccagccgtagctggccaccacgcgccagaaagtcggtgacagctgctcgatctgcacgcgacggacgttatgcacataaggcgcatcttccgtgcgcagcgtcagcaggatcacacgctcatgcagcactttgttgtgtttgagattatgcagcatggcaaaggggatgacgttcagcgcacgggacatatacacggcggtgcctggcacgcgcaccggcggcgatttctcaagcgaagcgatcatcgcttccagggaattgccgtgctcgtgcatgcggcgcagcagacggaaccgctcgcttttccaggtggtcatgatgataaacatcaccatgccgagactcaacggcagccagccgccggagagcagtttatcgaggttcgccgagaacagcggcacatcaatacacaggaaggcgaccagcaggaagcccaccagcaatttgttccagtgccagttttttcgcgccacggtcgccgacaaaatagtggtcagcaccatggtgccggtcaccgcaatgccgtaggccgccgccaggttgctggaatgctcgaagctgacgataacaatcaccaccgcgcaatagagcagccagttcacgaacggaatgtagatctgcccggattccatttccgaggtatgaatgatgcgcatcggcgacaaatagcccaggcgcaccgcctggcgggtcagggagaagacgccggagatcaccgcctgcgaagcgataaccgtcgccagggtggcgataatcagcataggtattaacgcccattcaggcgctaacaggaaaaacgggttcttgattgcttccggcgttttcagtaacagcgcgccctgcccgaaatagttcagcaccagcgacggcagcaccagactgaaccaggccacccggatcggcagcttgccgaagtgacccatatccgcgtacagcgcttccacgccggtaatcgacagcaccaccgcgccgagcgccacaaaagagacggctttatattcaaggaagaaatgcaccgcccatgccggattcagcgcctgcaacacttcagggttgccaataatcccgcgcagtccgagcaccgccagaatcaaaaaccacgccagcatgatcggcgcaaagagtttgcccaccagcccggtaccgtgcttctggatcataaacagcagcgtcaggacgatgatcgacagcggcaccacccaggtttccagtgacggtgcgacgatctccagcccctcgatcgcggacatcaccgaaatcgctggtgtgatcaccacttcaccatagaagaagctgccgccaatcaatcccatgatcaccagcaccgaggtcatacgggccgaggtgttacgcccggccagcgacatcagcgtcaggatcccaccttcaccggcgttatcggcgcgcattacaaaggacagatatttaacggatacgaccaggatcagcagccagaaaatgagcgataaaaagccgaacacggcatcgcgctcaacgccaaagccaaactgaccagacaaacattcacggagggtataaagcgggctggtaccgatatcaccgtacaccacgccgatggctgcgagcgttatcgcaggcaacgattgcttattatctgtgctcatagactaatcttttgtttgaatgccaactgtgtgcttagtcccttggcccacaaaagcgcacagtatgcacgattctttgccaaatcgtacccctaaatgcggccgggttatcctgcctcaatgaaaatgaaccggtacttcagtctattacaagcccctgttgaaacgtttatactcgcagctctgcgcctgaaacccggcgaaaggaagtaaatgaattatggctcacccacacttattagctgaaagaatttcccgtctcagtgctgcactggaaaaagggctttttgagcgcagccacgcgatccgcttatgcctgctggcggcgctcagcggcgagagcgtctttctgctcggcccaccgggaatagccaaaagccttatcgcccggcggctgaagttcgccttccgccatgcccgggcttttgagtatctgatgacgcgcttttccacaccggaagaggttttcggcccgctgtcgatccaggcattaaaagatgaagggcgttatgaacgtcttaccactggctacttaccggaagcggaaattgtctttttagatgagatctggaaggccggtccggcgatcctcaacacgttgctgacggccatcaatgaacgtcgtttccgcaacggcgctacggaagaaaaaatccccatgcgtctgctggtggcggcgtccaacgaactgccggaagcggacagcagcctcgaagcgctgtacgaccgtatgctgatccgcctgtggctggataaagtgcaggacaaggggaatttccgcgccatgctggtgagccagcaggatgaaaacgacaatccggttgccgatgccctgcagatcagcgacgaagagtatcagcagtggcagcaggacattggaaaaattgccctgcccgatgccgtctttgaactgatcttccagctgcgccagcagctggatagtctgccgaacgccccttatgtttccgatcgccgctggaaaaaagccattcgcctgttacaggccagcgcctttttctccggacgcgatgtcgtcgcgccgatcgatctgatcctgctcaaagactgcctgtggcatgacgcggatagcatgaatctgcttacacaacaaatagatattttgatgaccgttcacgcatggcagcaacaggcgatgctgacgaaactggcggccatcgggcagcgccgtcttcagctgcaacagcagcaaagcgataaaacggcgctacgggttctgcgtcagagcggcatgttcagccgccgcccgcactatgaactgccgccggaacttaccgacgcgaccctgacgctgcttcttcagcagccgctgaaactgcatgatatgcaggtgatccatctgaccattgagcgggccgcgcttgagcagtggctggcgaaaggcggggagatccgcggcaaacttaacggcattggttttgcacagttgctgaacctggaagtcgacagcacattacatctgatagtgcgcgacgtcagcctgcagggatcgcgccttgccctgccgggcagcgcgcaggaaaacgtgccggatgagatcactcaccagctggaagcgctggaaaatgaatggcaccagcagcatacgcgcttcagtgaacagcaaaaatgcctgtttattcacagcgactgggcgggtcgtattgaaggcagcctgcaggacgttggcgcgcagatcaaacaggcgcgtcaatgctgacgctggataccctcaatgtgatgctggcggttagcgaagaggggatgattgaagagttgatcgtcgccctgctggcctctccgcagctggcggttttttttgagaaattcccccgtctgcgccatgccatcaccgaggatattccccgctggcgggaggcattaaagggacggctgaaagacacccgcgtaccgccggagttgacggaagaagtgatcagctatcagcaaagccagctgctctccaccacgcagttgaccattcagctgccacagatcctcagcctgctggaaaaagtccactccccctatgccgcccaggcaaaacagctggtagcggataacgccacctttacccccgccctgcacacgctgtttttgcagcgctggcgcttaagcctggtggtgcagaccacggcgctcaaccagcaattactggaagaagagcgcgagcagttgctcagtgaagtgcaggagcgtatgacgctgagcgggcagctggatccggtgctggtggaaaacgacaatgcggccgggcggctgtgggatatgagcgccggacagcttaagcgcggcgactatcagctcataataaaatacggggattttctggccgcgcagcctgaactgaaaaagctggcggaacagctggggcgatcgcgtgaggcgaagtccgtaccacgcaacgatgcgccgatggaaaccttccgcacgctggtgcgcgagccgtcttcggtgcccgaacaggttgatggcctgcaacagagcgatgatattttacgtttgctgccaccggagctggccacgctgggcatcagcgagctggagtatgagttttatcgtcgcctggtggagaaacaactgctgacctatcgcttacagggcgaagcctggcgggagaagatcaccgagcggccggtggtgcatcaggattttgacgagcagccgcgcgggccttttatcgtctgcgtcgatacgtccggatcaatgggcggttttaatgagcagtgtgcgaaagcgttttgcctcgcgctgatgcgcgtggcgctggcggatcgacgccgctgttttatcatgctgttttccagcgaagtggtgcgctatgagctgtcgggcagggaaggcattgagcaggcgatccgctttttgagccagcgttttcgcggcggcaccgatctcgccagctgttttcgcgccatcatcgagcggatgcagggcggcgagtggttcgatgcggatgcagtggtgatctccgattttatcgcccagcgcctgccggacgaggtgatcggcaaaattaatgaactgcagcgcgtccatcagcatcgctttcatgcggtggcgatgtccgcccacggcaagcccggcattttgcgcattttcgatcatatctggcgctttgataccgggatgcgcagccgcctgctgcgacgctggcggcgctgaatcagagcagggatgagacgctgtcgcgtacctgcgcaggccatacgccgcactgtacctggccaatgtgcggcagttgcagcagcaacatggtcagacgtgactggccaatgccgccgccgatagtctgcggcatttgcccttccagcagcgcgcggtgccactccagcgccagacgatcttcatcgccggtcagcttcagctggcgtttaagggtttcggcgtcaacgcggatgcccatggaggagagctccagcgcatcttccagcaccgggttccacaccaggatgtcaccgttcagaccggcaaaaccggcttcggtgcgggtcgtccagtcatcataatccggggcgcgcacgtcgtgacgtttgccgtcgctcaggtcgccgccgataccgatcaggaacaccgcgcccagctctttcgcaatggcccgctcgcggcccttggcgtcgagaccagggaagcgggtcagcagctcttcgctgtgcacaaagtggatctgctctggcaggaacggtgcctgaccaaactccgcgctcactgccgcttctgtcgctttaatgcctgaccagatcgccgagacggtcgctttcagcgtgcccagatggcgctcgccgtcaccgaggacgcgctcccagtcccactgatcgacatagaccgagtggatcggcgtaagacgatcttcgtccgggcgcagggctttcatgtgcgtgtaaagcccttcccccgcgctgaagtcgtgttgtcccagcgtctgccgtttccacttcgccagtgagtgcaccacttcaaagcgcgcgtctggcagggttttcacattcacctgtaccgccttttcgcaaccagacaggttgtcctgcgtgccatcccccacgcggctgaggatcggagcctgaacttcgatcaggcccagtttttcctccagctggcgggagaagtgagctttaacgaaactgatctggcgttgttttgcgatgtaagcggttttcattattgaactcctgtgtcctgttgccattgattaagcaacaaaacgagagcgatattcaataatcaacagataaaaagcccggttcacttttgattccataaaatatggcgttaaactggactgaatcattaatctacataagaaaaacctatggaaaattatcagatcgataatctggatcgcggcatccttgaggcgctgatggcaaatgcgcgcacggcttatgccgaactcgccaagcagtttggcgtcagccccggcaccattcacgttcgcgtggagaagatgaaacaggcgggcatcattaccggcgcgcgtatcgatgtctgccctaaacaactcggctacgacgtctgctgctttatcggcatcattctcaaaagcgccaaagattacccctcggccctggcgaggctggagagtctggaagaagtgaccgaagcgtattacaccaccgggcactacagcatctttattaaggtgatgtgcaaatcgatcgacgcgctgcaacaggtacttatcaacaagatccaaacaattgatgaaattcagtccaccgaaacgctgatctcgctgcagaacccgatcatgcgcaccatccgcccgtgatcctctgaaataatcaccctgttttccacaggtagatcccagctcattcacagcgtacaatatgccacgcttaattgaggacggacgatcatggcagatattacgcttatcagtggcagcaccctgggcggagcagagtacgtggcggagcacctggctgaaaagctggacgaggcggggtacagcaccagcacccttcacggcccgctgcttgaggatctgccggtagaaggcgtgtggctgctggtttccagtacccatggcgcaggcgatctgccggataacattcttcctttatatgaagaactgaaagaacagcagccggatctgtctcaggtacgctttggggcgatcgggatcggcagtcgtgaatacgacaccttctgcggggcgatcgacaagctggaaagcgaaatgcgggcttgcggggcaaaacagatcggcgaaacgctgcggatcaacatcctcgatcatgatattcccgaggatccggcagaaatctggctgggatcctgggttaatttactcaatattgtgtaaagatcgtgcgatcagttgtgtataagtctggttaaaagcttggatcaaccggtatttatccactgtataaggtttgacgagtttttgggctgtgcataacccttcattttgatcccagcttatactgagtgggatcaccgatcattcacaggtaacgatcctttctaatgtattgatcttcaaagccggatccgggttatccacagagaggcacgatcctaataagagatcatagtaaaaaagatctctaaaagaaaaagatctcttaataacagtcaggatcccgactctttctcgatgggctaaagttgagtagaatccacggcccggcaccaatccactttctaaccgctcaggcgaggcaaaccaccatgttttatccggatcctttcgacgtcatcatcattggcgggggtcatgcaggcactgaggccgcaatggccgctgcgcgtatgggtcagcagaccctgcttttgacacacaatatcgacaccctgggacagatgtcgtgcaacccggcaatcggcggtattgggaaaggacacctggtaaaagaagtggatgcgctgggcggactgatggcaaaggccatcgatcaggcaggcattcagtttaggatactaaacgcgagcaagggcccggccgttcgcgccacccgtgctcaggcagaccgcgtgctttaccgtcaggcagtgcgcacggcccttgagaatcagccgaacctgatgatcttccagcaggcggttgaggatctgatcgtcgaaaacgatcgtgtcgtcggtgccgtgacgcaaatgggcctgaagttccgtgctaaatctgtcgtactgacggtcggcaccttcctcgacggtaaaattcatatcggcatggataactacagcggtggtcgcgcaggcgatccgccgtcgatttccctttcccgccgtctgcgcgagctgccgctgcgcgtcagccgcctgaaaaccgggacgccgccgcgtattgacgcgcgaactattgatttcagcgtgctggcggaacagcacggcgacacgccgctgccggtcttttcgttcatgggcaatgtggatcaacatccgcgccaggtgccgtgctatatcacctacactaacgaaaaaacccacgacgtgatccgcaataacctcgatcgcagcccgatgtatgccggcgtgatcgaagggatcggcccgcgttactgcccgtcgatcgaagacaaagtgatgcgctttgcggatcgtaaccagcatcagatcttccttgagccggaaggcctgacctctaacgaaatttacccgaacggcatctccaccagcctgccgttcgatgtacagatgcagatcgtccgatccatgcagggcatggaaaacgcgaagatcgtccgtccgggctatgcgatcgagtatgacttcttcgatccgcgtgacctgaaaccgacgctggaaagcaaatttatcgctggcctgttctttgccggtcagatcaacggcaccaccggttacgaagaagcggccgcgcagggtctgctggccggtctgaacgctgcccgcttctctgccgaaaaagagggctgggcgccgggccgttccgaggcttatctgggcgtgctggtggacgacctgtgcaccctgggcaccaaagagccgtaccgcatgttcacctcccgcgcggaataccgtctgatgctgcgtgaagacaacgcggatatccgtttaaccgcggcgggtcgtgagctgggcctggtggacgacgaacgctgggcgcgctttaacgagaaactggaaaatatcgagcgtgaacgccagcgcctgaaagatatctggctgcacccgcagtctgaaaagattgacgaagtgaatacgaagctgagcgcgccgctgtcccgcgaggcgaacggtgaagatctgctgcgtcgaccggaaatgacctatcgcgagatggtgcagctgtcgccgtttgcgccgggactcagcgatgcgcaggccgccgagcaggtcgagatccaggtgaaatacgaaggctatattgcgcgccagcaggacgagatcgacaaacagcagcgtaacgagaacaccgtgctgcctgcgaccctggactaccgccaggtgagcggtctgtccaacgaagtgatcgccaagcttaacgatcacaaaccgtcatccatcggtcaggcatcgcgtatctccggtatcactcctgcggcgatctccattctgctggtgtggctgaaaaagcagggtatgctgcgccgtagcgcttaattcaactttacccgcccggtagcgctagcttaccgggcctacagaacccgtaaggcggattagcgaagcgccacccgccgttaagtatctaaacaggtaatcaccgtgctcaacaaactctctcgtctgctggatgaagccgatatttcgctcaccgatcaccagaaaaaccagctggtggcctatgtcgatatgctgcacaaatggaacaaagcgtacaatctgacctcggtacgcgatccgaacgagatgctgatccgtcatattctggacagcgtggtggttgcgccgcacctggcggggtcgcgctttatcgacgtgggtaccgggccagggctgccggggatcccgctgtcaatcgtcttacctgacgcgcacttcacgctgctggacagcctcggcaagcgggtgcgttttctgcgccaggtgcagcacgagcttcgcctgactaacatcacgccggtgcagagccgcgttgaggatttcccggcggagccgccgtttgacggagtgatcagccgtgcctttgcttccctgaacgatatggtgagctggtgtcatcacctgccggggcagggggggcgtttctatgcgctgaagggccagttgcctgatgatgaaatcgaaaaactaccggcagactttgcggtggaatcggtgatcaaattgcgcgttccgcaactggacggcgaacgtcatctggtgatgattaaaccaaacaatatttaatttttatcaaaaaatgttaattccgtactgtagtgaatgtgttaaaaatcagcacgcagaaacggaataaatcccgttaggcttaaccttatttttactgggatttttctgtttgttaacctggcattttttgttaaccggcaaaataatcaaccagggaagtatatgtctgctaaaaatcagtaatgcttaacgtttagcgatgttaaaaatttattaagaatgtcaataaaaggtttttgttgtatatgaagctgttttggaaatagtcgcagttattcatcttgaatatcagaaagatggtgactgtgattattatgcttcaatgaaagacgcttaaacgcaaatgcgcaatttgtgatctggtgcacgctttagcatcaggcttttcgcgcgattggcaatcctgttcgatggttcacactttacaaaaaagtggaaaaatagccctcgagaaatttatttaaacatttattcaccttttcgctacttattgtttgaaatcacgaggccgcaccgtataatttgctcgctttttgatgcttgactctgagccttaaagaacgttttatacgacacgcgacatacctcgttgggggcaggagtaaaaaacgtgatgtctttgtcgctcttgagtcgaaacgttgctcgtaagcttctgttcattcagttcctggcagtgatagcaagcgcattgctattttgccttaaagaccccttctggggcgtctccgcagtatgcggtgggctggcagtggtactgccaaatatgttgtttatgatttttgcctggcgtcatcaggcgcatacacctgctaaaggccgcatggcctggtccttcgccttcggggaagtgttcaaggtgttggcgacctttaccctactggtggtggcgctggcggttttgaaggcggtctttttgccgctgatcgtcacgtgggtttcggtgctggttgtacagatactggcacccgctgtaattaacaacaaagggtaagaggcatcatgtctgcaggagaaatctcaacaccgcaggagtacataggccaccatctgaataaccttcagattgacctgcgtaccttttcgctggtggatccgcataaccccccagccactttctggacgcttaacatcgactccatgttcttctcggtgcttctgggtctgttgttcctcgtgatgttccgtagcgttgccaaaaaagcaaccagcggcgttccgggaaaattccagacggcgatcgagctggtcattggcttcgtcaacggcagcgtgaaagacatgtaccacggcaagagcaaactgattgctccgctggccctgacgattttcgtctgggtattcctgatgaacctgatggatttgctgcctatcgacctgctgccgtatatcggcgagcatgtattcggcctgccggctctgcgtgtggttccgtccgctgacgtgaacatcaccctgtcgatggcgctgggcgtatttatcctcattctgttctacagcatcaaaatgaaaggcattggcggcttcaccaaagagctgaccttacagccgttcaaccactgggcatttattcctgtcaacttaatccttgaaggggtaagcctgctgtctaaaccggtatcactcggtctgcgactgttcggcaacatgtatgccggtgagttgatcttcattctgattgcaggacttctgccatggtggtcacagtggatcctgaatgtgccatgggccattttccacatcctgatcattacgctgcaagccttcattttcatggttctgacgattgtctatctgtcgatggcatctgaagagcattgattttaccaacactactacgttctaactgaaacaaactggagactgtcatggaaaacctgaatatggatctgctgtacatggctgccgctgtgatgatgggtctggcggcaatcggtgctgcgatcggtatcggcatcctcgggggcaaattcctggaaggcgcagcgcgtcaaccggatctgatccctctgctgcgtactcagttctttatcgttatgggtctggtggatgctatcccgatgatcgctgtaggtctgggtctgtacgtgatgtttgctgtcgcgtagtaagcgttgcttgattaagcaatttttagaacgttaaccagataagaggcattgtgctgtgaatcttaacgcaacaatcctcggccaggccatcgcgtttgtcctgttcgttctgttctgcatgaagtatgtatggccgccgttgatcgctgccattgagaaacgtcaaaaagaaattgctgacggcctcgcttctgcagaacgagctaaaaaggatttggaccttgcacaggccaatgcgaccgaccagctgaaaaaggcgaaagcggaagcccaggtaatcattgagcaggcgaacaaacgtcgcgctcagatcctggacgaagccaaaaccgaagcagaacaggaacgtaccaaaatcgttgcacaggctcaggcagaaattgatgctgagcgtaaacgtgctcgtgaggaactgcgtaagcaagttgctatcctggctgttgctggcgccgagaagatcatcgaacgttccgtggatgaagctgctaacagcgacatcgtggacaaacttgtcgctgaactgtaaggagggaggggctgatgtctgaatttgttacggtagctcgcccctacgccaaagcagcttttgactttgctgtcgaaacccaaagtgtcgatcgctggcagaacatgctggcgtttgccgcagaggtaacgaaaaacgaacatatggcggagatgctttcaggtgcactggcaccggaaactctcgccgcgtcgttcatcgccgtttgcggcgagcaacttgataccaacggccagaacctgatcaaggtaatggctgagaatggtcgtctgagagtgctcccggatgttcttgagcagtttgagcacttacgtgcccttagtgaagctaccgctgaagttgaagtaacctcggcgaccgaactgagtgaagaacagcttgcgaagattaccgccgcgatggaaaaacgtctgtcacgcaaagttaagctgaattgcaatatcgataagtctgtaatggcgggcgtaatcatccagtcgggtgatatggtcattgatggcagcgtacgcggccgtctacaacgcctcgcagacgtcttgcagtcttaaggggactggagcatgcaactgaattccaccgaaatcagcgaactgatcaagcagcgcattgctcagttcagtgttgtgagcgaagctcataacgaaggtactattgtttctgtaagtgacggtgttatccgcattcacggcctggccgattgtatgcagggtgaaatgatctccctgccgggtaaccgttacgctatcgcactgaacctggagcgcgactccgtaggtgctgttgtgatgggtccgtatgctgacctcgccgaaggcatgaaggttaaatgtactggccgtattcttgaagtaccggtaggccgtggcctgctgggccgcgtggtgaacaccctgggtgcgccaatcgacggtaaaggtccggttgataacgatggcttctcgccaatcgaagttatcgcaccgggcgtaatcgatcgtcagtccgtcgatcagccggtacagaccggttacaaatccgttgatgccatgatcccaatcggtcgtggtcagcgtgagctgatcatcggcgaccgtcagaccggtaaaaccgcgatggctatcgatgcgatcatcaaccagcgtgactccggcatcaaatgcgtatacgtggcaatcggccagaaagcgtccaccatctctaacgtggtgcgtaaactggaagagcacggcgcgctgtccaacactatcgttgtggtggctaccgcttctgaatccgctgcgctgcaatacctggctccgtatgccggttgcgccatgggcgaatacttccgtgaccgcggtgaagatgcgctgatcgtttatgatgacctgtccaaacaggctgttgcataccgtcaggtttccctgctgctgcgccgtccgccaggacgtgaagcattcccgggcgacgtgttttatctccactcccgtctgctggagcgcgcatcccgcgtaaacgcggaatacgttgagaacttcaccaaaggtgaagtgaaaggtaaaactggctccctgaccgcgctgccgatcattgaaacccaggcgggtgacgtttctgcgttcgttccgaccaacgtaatttctattaccgatggtcagatcttcctggaaaccaacctgtttaactccggtattcgtccggcggttaacccgggtatctccgtatcccgtgttggtggtgctgctcagaccaagatcatcaagaaactgtccggtggtattcgtaccgcgctggcacagtatcgtgaactggctgcgttctctcagttcgcatccgatctggatgaagctacccgtaaacagctgagccatggtcagaaagtgaccgagctgctgaaacagaaacagtatgccccaatgtctgttgcacaacagggcctggtgctgttcgcggctgaacgcggttacctcgaagatgtggaactggcgaaaatcggtagcttcgaagccgctctgctggcttacgttgaccgtgaccacgctccgctgatgcaagagatcaaccagtccggtggctataacgacgaaatcgaaggcaagctgaaaggcatcctcgattccttcaaagcaacccagtcctggtaacgtctggcggtctgtcctagggcagaccgcaaggcattgaggagaagctcatggccggcgcaaaagagatacgtagtaagatcgcaagcgtccagaacacgcagaagatcactaaagcgatggagatggtcgccgcttccaaaatgcgtaaatcgcaggacagaatggcggccagccgtccttatgcagataccatgcgcaaagtgattggtcaccttgcgaacggcaatctggaatataagcacccttacctggaagaacgcgacgttaagcgcgtgggctacctggtggtgtcgaccgaccgtggtctgtgcggtggcttgaacattaacctgttcaaaaaactgctggcggaaatgaaagtatggtccgataaaggcgttcagagcgatatcgcgatgatcggctctaaaggcgtttctttcttcaattccgtggggggcaatattgtcgcccaggtgaccggtatgggtgataacccgtccctgtccgaactgatcggcccggtaaaagtgatgttgcaggcctacgatgaaggccgtctggacaggctgtacattgtcagcaacaaatttattaacaccatgtctcaggttccgaccctcactcagctgctgccgttaccggcatcagaagacggtgagctgaagcagaaagcctgggattacctgtatgaacccgatccgaaaccgctgctggataccctgctgcgtcgttacgttgagtcgcaggtttatcagggcgtggtagaaaacctggccagcgagcaggccgcacgtatggtggcgatgaaagccgcgaccgacaatggcggcagcctgattaaagagctgcagttggtatacaacaaagctcgtcaggccagcattactcaggaactcaccgaaatcgtcggtggtgcatccgcggtataaccaggttaattcgtagaggattcaagatggctactggaaaaattgtccaggtaatcggcgccgtggttgacgtcgaattccctcaggatgccgtaccgcgtgtgtacgatgctcttgaggtacaaaatggtaacgagagcctggtgctggaagttcagcagcagctcggtggtggtatcgtgcgtactatcgccatgggttcttctgacggtctgcgtcgtggtctggaagtaaaagaccttgagcacccgattgaagtaccggtaggtaaagcaacactgggtcgtatcatgaacgtgctcggtcagccgatcgacatgaaaggcgacatcggtgaagaagagcgttgggcgatccaccgcgcggcaccaagctacgaagaactgtccagctctcaggaactgctggaaaccggcatcaaggttatcgacctgatgtgtccgttcgctaagggcggtaaagtcggtctgttcggcggtgcgggtgtgggtaaaaccgtaaacatgatggagctgatccgtaacatcgcgatcgagcactccggctattccgtgtttgcaggcgtgggtgagcgtactcgtgagggtaacgacttctaccacgaaatgactgactccaacgttctggacaaagtatccctggtttacggtcagatgaacgagccgccgggaaaccgtctgcgcgttgcgctgaccggcctgaccatggctgagaaattccgtgacgaaggtcgtgacgttctgctgttcgtcgataacatttatcgttataccctggccggtacggaagtatccgcactgctgggccgtatgccttctgcggtaggctatcagccgaccctggcagaagagatgggtgtgttgcaggaacgtatcacctccaccaaaaccggttctatcacctccgttcaggcggtatacgtacctgcggatgacctgactgacccgtcgccagccaccacctttgcgcacttagacgcaaccgtggtactgagccgtcagatcgcgtctctgggtatctatccggccgttgacccgctggattccaccagccgtcagctggatccgctggtggttggtcaggaacactacgacaccgcgcgtggcgtacagtccctgctgcaacgttaccaggaactgaaagacatcatcgccatcctgggtatggatgaactgtctgaagaagacaaactggtggtagctcgcgcacgtaagatccagcgcttcctgtcccagccgttcttcgtggcagaagtatttaccggttctccgggcaaatacgtctccctgaaagacaccatccgtggctttaaaggcatcatggaaggcgaatacgatcacctgccggagcaggcgttctacatggttggttccatcgacgaagccgtggaaaaagccaaaaaactttaacgccttaatcggagggtgatatggcaatgacttaccacctggacgtcgtcagcgcagagcaacaaatgttctccgggctggtcgaaaaaatccaggtaacgggcagtgaaggtgaactgggtattttcccgggtcacgccccgctgctcaccgccattaagcctggtatgatccgcatcgttaaacagttcggtcacgaagagtttatctacctgtccggcggcattattgaagtgcagcctggcagcgtgaccgttctcgctgatactgctattcgtggccaggatctcgacgaagcgcgagctctggaagcgaaacgtaaagcagaagagcacattaagagctctcatggcgacgtggattacgctcaggcgtctgcggagctggccaaagcgatcgcgaaactgcgtgttatcgagttgaccaaaaaagcgatgtaacaccggcttgaaaagcacaaagccagtctggttgccaggctggctttttttatgcttccacgagaatgggttgataaatgaaatggtgtttcttattttttgtgattaacatcacaaaaatattgatcggtgaaaatttgaggtgtagacttatttttgtgaagtaagtcacataaacgaattcaaccgccgggaaaacatcatgaaactgattaacaaaattatcgctttcttcaacaacatgaacgtttcttttggtacttttaatctgtaatcacgtagtgccgccaattaaaacgacaaccgctggtggcgtgaacagacatcaataaaggtcgcccgaggcggcctttatgcttttaataattcagtcaaaatatcccccgttcgtacggcttcgcgccccgcttaactcctctatactcacctttgctgctgtcagcctggctacgttttctttattcattctgcgaaaaaataagtaaaacatcggcataacaactttacagcccgtgatatgttcattttttacggtaaatggcatcatgacggccggaaaacggggcgcagaaggggattattaccggtctgctggcatttaatctgcgacccaattcacggcgaaaaaaatgtagtattttcaatgtgaaaaagtaaaaattcaccctcaaattacagtcaggacgcgtatgttgaacagtgctatgagtgtggtcatccttgccgctggtaaagggacccgcatgtattccgatcttcccaaagtgctgcacacccttgcagggaaagcgatggtccagcatgtcattgatgccgcgaatgaactgggcgccagccgcgttcatctggtttacgggcatggcggcgatttgctgaagcagacattgcgcgacgataagctgaactgggtgctacaggctgaacaactgggcaccggccacgctatgcagatggctgcgccgaactttgctgataacgaagatattttgatgctctacggcgatgtgccgctgatttcggtcgccactctgcaacgcctgcgtgacgccaaaccgcagaacggcattggtttactgacggtaaatctcagcgatccaaccggctatggccgtatcacccgcgagaacggtaaagtgaccgggatcgtagagcacaaagatgccaccgatgagcagcgtcagatccaggaaatcaataccggcattctgatcgccaatggcgcagacatgaagcgctggctggcgaaactgaccaacaacaatgcgcagggtgaatactacatcaccgatattatctcgctggcttatcacgaagggcgtgaaattgccgccgtccacccggaaaggctgagcgaagtggaaggcgtgaacaaccgcctgcagctgtcccgtctggagcgcgtctatcaggctgagcaggctgaaaagctgctgctggcaggggttatgctgcgcgatccggcgcgtttcgatttacgcggctccctgacccacgggcgcgatgtggaaatcgatactaacgtcattctcgaaggtaacgtcaccctggggcatcgcgtgaagatcggcgcaggctgcgtgatcaaaaacagcgtgattggcgatgactgcgaaatcagtccttacagcgtggtggaagatgctgaactggccgccgcctgcaccatcggcccgtttgcgcgtctgcgtccgggtgccgagctgctggaaggcgcgcacgtcggcaacttcgtggaaatgaaaaaagcgcgtctgggtaaaggctcgaaagcgggtcatctcacctacctgggcgatgcggaaattggcgataacgtgaacatcggcgcgggcacaatcacctgcaactacgatggcgccaataagcataaaaccattattggcgatgacgtgtttgtcggctccgatacgcagctggtggcgccggtaacggtagccagtggcgcaagcatcggcgcgggcaccacggtaacgaatgacatcgcggaaaatgaactggtcatcagccgggtacgtcagacccatatcaagggctggaaacgtccggtgaagaagaagtaacaatgtggcgggtggtgcttcgctaacccgccctacggttttctgccggataaacgttagtgccatccggcaaaaagggatgaggagataaacatatatctcccgcccaccagcagtaaccataaaaataaccccactctctacaaggctcggggcgcccgatacgggcaaaacaggtcggcgacaacgcatcattatcaggaaattaactatgtgtggaattgttggcgcagtcgcgcagcgtgatattgctgaaatccttctcgaaggcttacgtcgtctggaatatcgtggttatgactctgcgggactggccgtcgtcgataacgaagggcacatgacccgtctgcgtcgtctgggtaaagttcagatgctgtctcaggctgcggaagaacatccgctccatggcggtacggggatcgcacatacacgctgggcaacccacggtgaaccttcggaagggaatgcgcacccgcatgtgtccgaacacattgtggtggtccataacggtattattgagaaccatgagccgctgcgtgaagtattgcaggcacgtggctacgtctttgcctccgaaaccgataccgaagtgattgctcacctcgttcactgggagctggagcagggcggcacgctgcgtgacgccgtgttacgtgccatccctcagctgcgcggtgcctacggtacggtgatcatggatacccgtcatccggatactctgctggccgcccgttccggcagcccgctggtcattggcctcggcatgggcgaaaacttcatcgcttccgatcagttagctctgctgccggtcacccgtcgctttatctatctggaagaaggcgatatcgctgaagttacgcgccgcagcgtgaccgtattcgataagtctggccatgaagttacgcgcccggacatcgaatctaatctgcaatacgacgcgggcgataaaggtatctatcgccactacatgcaaaaagagatttatgagcagccgaacgccatcaaaaacactctgaccgggcgtatcagccacggcgaagtggatttaagcgagctgggcgcgaatgccaatgacatgctgtcacaggttgagcatatccagatcgtagcctgcggcacctcgtacaactccggtatggtgtcacgctactggtttgaatccctggcgggcgtgccctgtgacgtggagatcgcctctgagttccgctatcgcaaatccgcggtgcgtcgcaacagcctgatgatcaccctgtcccagtccggtgaaacggcagataccttggccgcgctgcgcttgtcgaaagagctgggttacctcggttcgctggcgatctgtaacgtgccgggctcctcgctggtgcgtgaatccgatctggcgatgatgaccaacgccgggactgaaatcggtgtggcttccaccaaagccttcaccacccagttaacggtgctgctgatgctggtggcgaagttaagccgtctgaaaggcatggacgcgtccattgagcatgacattgtgcatggtctgcaggcgctgccgagccgtatcgagcagatgctgtcgcaggacaaacgcatcgaagcactggcagaagatttctccgacaagcatcacgcgctgttccttggccgtggcgatcagtatccgatcgcgctggaaggcgcgctgaagcttaaagagatctcctatatccatgctgaagcctatgcggcgggcgagctgaaacacggcccgctggcgctgattgacgccgatatgccggtcatcgtggtggcaccgaacaacgaactgctggaaaaactgaaatccaacattgaagaagtgcgcgcccgtggcggccagctgtacgtcttcgccgatcgtgatgccggtttcaacagcagtgacaacatgcacattatcgaaatgccgcatgtggaagaggtgatcgcaccgattttctataccgtgccgctgcagttactggcctatcacgttgcgctgatcaaaggcaccgacgttgaccagccgcgtaacctggcaaaatccgttacggttgagtaaataaatcaaagccccgtctgcaaaggcggggcttttactgtctgcgctgttctgtttttatacacatttgcggcacccttctttatgacaaactgtcatcttcagctacttttaatcctgtaataaaaataaaatcacgctgtcatgctctgttcataaatcttataattatttgattataatgattttattttggctatcccaccagcagccccgactgtcataaaactgtcatatttcatacattttactgtcacctgtttgtcctattttgcataccggagctactcaaacaacgatttacgaaatcttgcaggagtcattatgaaagccatgcgtaccactgtcgccactgttgtcgctgcgaccttatctctgagcgcttttgctgttaacgcagcagcaagcctgactggcgcgggtgcaaccttcccggcgccggtgtatgccaaatgggctgatacttaccagaaagccaccggtagcaaagtaaactaccagggtatcggctcctccggcggcgtgaagcaaattaccgctaacaccgttgatttcggcgcgtctgatgctccgctgtctgatgaaaaactggctcaggaaggcctcttccagttccctaccgtgatcggtggcgtggtgctggcggttaacctgcagggcgtgaaatccggcgaactggtgctggacggcaaaaccctgggtgatatttacctcggcaaaatcaaaaaatgggatgacgccgcgattgcgaaactcaacccaggcctgaaactgccttcgcagaacatcgccgttgtgcgtcgcgctgatggttccggcacctctttcgtgttcaccagctacctggcgaaagtgaacgaagagtggaaatctaaaattggttcaggctctaccgtaaactggccgaccggtctgggcggtaaaggcaacgacggcatcgccgcgttcgttcagcgtctgccaggctctatcggttacgttgaatacgcctacgctaaacagaacaacctggcttacaccaaactggtgtctgcggatggcaaaccggtatccccgaccgaagaaagcttctctaacgccgccaaaggcgtggactggagcaaaaccttcgctcaggacctgactaaccagaaaggcgatgacgcgtggccgatcacctccaccaccttcattctgatccacaaagagcagaagaaacctgagcagggcgcagaagtgctgaagttctttgactgggcttataaagatggcgctaaacaggcgaatgacctggattacgctaccctgccggacaacgtggttgagcagatccgtgcggcatggaaaaccaacgtgaaagacagcagcggtaaagcgctgtactaagcaaagtagttaatgatggcggatggcgctttcgcttatccgccctacaaaaatccgctaacatgctttttttgtaggcccggtaagcggcgacgccaccgggcatcgttcaaaacagagttcaactaaaagagtgacctatggctgcaactaagcccgcttttaacccaccgggtaaacaaggcgacatgatcttcagcgcactggtaaaactggctgcgctgattgtgctattgctgctgggcggcattattgtgtcgcttattttctcctcctggccaagcatccagaagtttggtttctctttcctgtggaccaaagactgggacgcgcctaacgatatttacggggcgttagtgccaatttacggcacgctggtaacctcatttatcgcgctgctgatcgccgttccggtgagtttcggcattgccctgtttctgactgaactggcgcctggctggctgcgtcgcccgctcggtatcgccattgaactgctggcggctatccccagtatcgtttacggcatgtgggggctgttcatcttcgcgcccttgtttgcgaaatatttccaggagccggtcggcaacgtactgtcgaacattccgtttgtgggcgcgctcttctccggcccggcattcggtatcggtattctggcagccggggtgatcctcgccatcatgatcattccgtacatcgcctccgtaatgcgcgacgtgttcgaacaaacgccggtgatgatgaaagaatcggcatacggcatcggctgcaccacctgggaagtgatctggcgcattgttctgccgttcaccaaaaatggggtcatcggcggcgtgatgcttggccttggccgcgcgctgggtgaaaccatggcggtgacttttatcatcggcaacacctaccagctcgacagcgcctcgctgtatatgcctggcaacagcattacctctgcgctggcaaacgaatttgcggaagccgaatccggcctgcacgtttcggcgctgatggagctggggctgatcctctttgtgatcacctttatcgtgctggcgatttctaaggtcatgatcatgcgcctggcgaaaaacgagggggcacgataatggcgacgctcgaaatgcaaaacaccacggctctggcggaatcacgtcgtaaaatgcaggcccgtcgtcgtctcaagaaccgtatcgcgctgacgctctcgatggcgaccatggcgttcggtctgttctggctggtctggatcctgttttccacggtgacgcgcggtatcgatggcatgtcgctggcgttattcaccgaaatgacgccgccgcctaatacggcgggtgggggcctggcaaacgccctggcgggcagcggcctgttaattttctgggccaccgcaatcgggacgccgctgggcattatggccggtatttatctggcggagtatggccgcaaatcctggctgtcagaagtgatccgtttcattaacgatattctgctctctgcgccgtcgattgtggttggtctgttcgtttacaccattgtggtggcgcagatggagcacttctctggctgggcaggcgtgatcgcgctggcgctgttgcaggtgccgattgtcatccgtaccacggagaacatgctgaaactggtgccggacagcctgcgtgaagcggcttatgcgctgggcacgcctaagtggaagatgatctcttccattacgttaaaagcctctgtttccggcatcctgaccggcatcctgctggccgttgcgcgtatcgccggtgaaaccgcgccgctgctgtttaccgcgctctccaaccagttctggagcacggacatgatgcagcctatcgccaacctaccggtgacaattttcaaatttgccatgagtccgtttgccgagtggcaggaactggcctgggcaggcgtgctgattatcaccctgtgcgtactgttgctgaacattctggcgcgcgtgatcttcgcgaagaagaaacacggttaatattttgcggcggggccatgggccgcgccgaatgaggaaagagtaaaatgagtatggttgagactgcatccggtaagatccaggttcgtgatttgaacttctattacgggaaattccatgccctgaaaaatatcagtctggatattgccaaaaaccaggtgacggcgtttatcggcccgtcaggctgtggcaaatccaccctgctgcgtacttttaacaaaatgtactcgctctacccggagcagcgtgcagaaggcgaaatcctgctggatggcgacaatattctcaccaatacccaggacatcgcgctgctgcgcgccaaagtcggtatggtcttccagaagccgacgccgttcccgatgtcgatttacgacaacatcgccttcggcgtacgcctgtttgaaaagctctcccgcaccgacatggacgagcgcgtccagtgggcgctgaccaaggccgcgttatggaatgaaaccaaagataaactgcaccagagcggttattcactctccggtggtcagcagcagcgtttatgtatcgcccgcggcatcgccattcgcccggaagtgctgctgctggatgagccctgctcagcgctggatcctatatccacaggccgcattgaagagctgatcaccgagttaaaacaggattacaccgtggttatcgtgacccacaacatgcagcaggctgcgcgttgctccgatcacacggcgtttatgtaccttggcgagcttattgagttcagcaacaccgacgatctgtttaccaagccggctaagaaacaaactgaagattacatcacgggtcgctacggctgattcaggagcacgctatggataaccttaacctcaataaacacatttccggccagttcaacgccgagctggaaagtattcgcactcaggtcatgaccatgggtggaatggtggagcagcagctctctgacgctatcaccgccatgcacaatcaggacagcgagctggccaagcgcgttgtggcaggcgaccagcaggtcaatatgatggaagtcgcaatcgatgaagcctgtgtgcgcatcatcgccaagcgtcagcctaccgccagcgacctgcgtctggtaatggcgatcatcaaaaccatcgccgagcttgagcgtattggcgatgtggccgacaaaatttgccgtacggcgctggagaaattctctcagcaacaccagccgctgctggtgagcctggagtcccttggccgccacacggtgcagatgctgcatgatgtgctggatgcgttcgcgcgcatggatctcgatgaagcgatccgtatttatcgcgaagacaagaaagtggatcaggaatatgaaggcattgtgcgccagttgatgacctacatgatggaagatccgcgcacgatcccaagcgtactgacagcgctgttctgcgcgcgctccatcgagcgtatcggcgaccgttgccagaacatttgcgaatacattttctacttcgtgaaaggtcaggatttccgtcacgtgggcggcgacgagctggacaaactgctcgccggcagcgatccgaaagagtgatcttttaaggccggatatccggccttaatttcagaacctgtaggccggataagcgtcagcgccatccggcattttttagcgggtaatatcccacccgcgcgccttccacaattccggcagctgcgccagatcggtaaaggtcgtcaccttcgggtggtcaaggggcttattatgcggatcggcgcagaagtagaacacttccatgcccgccgcgatgcccgcctgcgccccggccgaggaatcatccaccagaatacatttcgtcggatcgacgttcattgctttcgcggcgtggtacatcagcgccggatcgggtttccagcgctgaatatcgtagccgctgaacaataaatccgggaaatggtgcagcattcccagcttacccagcgaatgattcattttgcttaccggcccgttggacaccacacacatcggtacggtcatcgcgtccagcaacgcatttgcacccgcaatgacttcaagttcgctgtcgaacagacgtgcgacctcggcgcggtagacaggttcgagatcggctttcgccagatccacgccgttttcggcgttaacgatgtcgataatctcgtagagtttcacgcccttaaagcgtttaaatacctcctcaagatcaagcgtaatgccaaattcccggaacatatggacataagcccgggaacaaatcacttcactgtcgaccagcgtgccgtcacagtcgaaaaataccgcgtcaatttgggacatgccgtttcctgttttaatgcaattttaacgattacgtgatgcagattacgccgcgcaatcgttgccgtataagcaaaatcaatgaaaaaaaatgggtgatacccatcaccattgtcgcattttggtataggatagcgacggatttttccctcccatgtttggaaattgataatgagccaacaacacaccacccagccatcaggccaggggttgctcgaccgcgtgtttaaactgcgtgaacacggcacaacggcacgcaccgaagtcatcgccgggttcaccaccttcctgacgatggtctatatcgtttttgttaacccgcaaatcctgggcgccgctggcatggataccagcgcggtgtttgtgaccacctgtcttatcgccgcgcttggcagcattctgatgggcgtgttcgctaacctgccggtggcgctggcaccggcaatgggtctgaacgctttctttgcatttgtggtggtgggcgccatggggctgccgtggcaaatcggcatgggcgcgatcttctggggcgcgattggcctgctgttgctgaccattttccgcgtacgttactggatgattgccaatatcccggtcagcctgcgcgtgggtatcaccagcggcatcggtttattcatcggcatgatgggtctgaaaaacgccggtgtgatcgtggcgaacccggaaaccctcgtcaccattggtaatctgtcgtcgcacagcgtactgctgggcgtgctgggcttctttatcatcgctattctggcctcgcgtaatattcacgcggccgtgctggtttccattgtggtcaccacactgctgggctggatgctgggcgatgtgcattacggtggtatcgtttctgcgccgccgagcgtgaccagtgtggtcggtcatgtggatttagccggttcctttaatctgggcctcgcgggcgtgatcttctcgttcatgctggtgaacctgttcgactcctccggtacgctgattggcgtgacggataaagcgggcctggcggatgaaaaaggtaaattcccgcgcatgaagcaggcgctgtttgtggatagcgtgtcgtctgtggcaggctcattcatcggcacctcctccgtgaccgcgtacattgaatcctcgtccggcgtgtccgtgggtggccgcaccggtctgaccgcggtagtggtaggtgtgctgttcctgctggtgatcttcctgtcgccgctggcgggcatggtgccgccgtatgccgccgcaggcgcgctgatttacgtgggcgtgctgatgacgtcaagcctggcgcgggtgaagtgggatgatctgaccgaagcggtaccggcctttatcactgccgtgatgatgccgttcagcttctcgatcaccgaaggcatcgcgctgggctttatctcttactgcgtgatgaaaatcggtaccggccgtctgcgcgaactcagcccatgcgtggttgtcgtggcgctgctgtttgtgctgaagattgcctttatcgacgcgcattaatccttgctccctcatcctggcaaaatagccggggtgagggcagaccttctctcaggcaggcaaactgctgaaccgcatcaggcgcgccgcaggggcattcgcccgctgttgaatatccggcaggctgctccagccgcttttactgtcaaatgcccagatccgcagcgtttccatcgccggtgagacggctaccgaccagatcagcacatcctccgcatcacacaaggcttccaccggtgccgccagcgccgcccgcagacgacctgagcccggcagcaactgtaacagctccggcgagtcctgcgtctggctggccatctttaacacgctctgacgcagcgtgataagctgcgtctgggcttcattgggatcgttctggttaccgatccacagcttttcattgttagtgaagatctgccgttcctgcgcatgggggctgtgcagaccgcgcgtcgtccgctgtaactccatatccagcccacaaataccatcggtggtgatcgccacgccaaccatattcccggcgtaggcgagggaaaaatgcggtaactgcatatcaaaaaataccggacggccgttcggctggatgacgatgtccggcagttcgctgatgccgtaaagcataaacatcagttcagcgagtaacgcccgggaggcaagaaagcggtggcgctgatgttcaggtaattgacgtgcggcgtggtggcaggcagaaggcagcctcgttgaggtgagatgaccgtcggtcaggatccctcttgcaaagtgtgttgccatttttcgctccgtgataatggtctgaaggatcagacaacgaggatagctaatggcctgtattgtgcgcaggtttgattaaggaaaaaagaggatttgaaccgccgtgccggaattttacatttcctttaacagcaggccctgaaaacgaaaaaacccgccagaggcgggttttaaaatgctttgcttagaacggagaagcttacaggcttacaacgttaccagctgccgggcctttagcgccgctttcgatggtgaaggacactttctgaccttcgtccagagatttgtagccatcgttctggatagcagagaagtgtacgaacacgtctttagagccatcgtcaggagtgatgaagccgaaacctttatcagcgttgaaccattttaccagaccagtcattttagcagacatagaaattacctttgatattgaattagtgcctttcggcgcgatggtgtgcttgacagaatttttgaagcgattaagagaagctcacgacgaagggtatctttggataacttctggaggactactttactaactgctttaaaggtctgtgcgtcaaaccaatgagtctattaacgcacagatccttagtgagtagcaatgtttattttaaagagatcacttaccgatgcagaaactggagaagatccggcccagcagatcgtcggacgtgaactcgccggtgatctcgcttaacgccagctgcgccagccgcagctcttccgccagcagttcgccagcccatgcgccgagcagttgcgccttaccctgttgcagatggtcagccgccagttccagcgcctgtaaatgacgacgacgcgccataaagccgccttccatacgcgtatcaaagcccatgctggctttaagatggtggcgcagtacatccacaccctcgccggtgcgcgcggagaggcgcacaagtgagtgaccattcacatcactgatgcccagcgtctcgccggtgatgtctgctttgttacgcaccacggtaataggtaactttgccggcagccgggcgataaaatcgggccagatttctgccggatcaactgcgctggtggtggtgccgtccaccataaacaatacccggtcagcctgttcgatctcctgccaggcgcgctcgataccaatacgctcgacttcatcgctggcttcgcgcagaccggcagtatcaatgatatgcagcggcatcccgtcgatatgaatatgctcgcgcagcacatcacgcgtggtaccggcgatatcggtgacaatcgccgcctcacgcccggccagcgcgttcagcaggctggatttaccggcattcggacggcctgcgatcaccactttcatcccttcccgcagcaggctgccctgacgcgcttcagcgcgaacggcatccagatcgccaatcacctcgttaagctgcgcttcgattttaccgtcagagagaaaatcaatttcttcgtccggaaagtcgatggccgcttcaacgtaaatgcgtaagtgagtgagtgcttccaccagatgattcacgcgggcggaaaacgcgccctgcaacgagttcagcgccgagcgtgcggcctgttctgagctggcgtcgatgagatcggcaatggcctcggcctgggccagatccagcttatcgttgaggaaggcgcgttcagagaactcgccaggccgcgcaatacgcacgccggggatcttcaggatgcgttttaacagcagatcgagaataaccggtccgccgtgcccctggagttccagcacgtcttccccggtaaaggagttggggccggggaaccacagcgcgatcccctgatccagcgcgctgccatcaacatcctgaaacggcaggtaatcggcgtaacgcggcttcggcagcttgcccagtacaacgtcagccacttcccgcgctttaaggccagagatgcgcagaatgcccacgccaccgcgtccagggggggtggcctgcgcaacgatagtgtcgttatggctcatgatttatctctttaaaaccaataaaaaaggcggtcaatcgaccgccctgtcagaacttttctgtttgccgggtggcgctttgcttacccggcaaacatgacgtcaggagcttttcttctcgcggctatgcaggccacgtttctccagaccacggtaaatcatctgttgttgcagaatggtcaccaggttgctgacgatatagtacagcaccagaccagacgggaaccacaggaagaacaccgtaaagatgaccggcataaaggtcatgattttctgctgcatcggatcggtaacggtcgtcggcgacatcttctgaatgaagaacatggtcacgcccatcaggatcggcagaatgtagtacgggtcttgtgcggacaggtcatggatccacagcgcgaacggcgcatgacgcagttcaatggagcccatcagcatgtagtacagcgccaggaagattggcatctggataagcagcgggaagcagccgcccagcgggttaaccttctctgctttgtacagcgccatcatttcctggctctgacgttgcttgtcatcacccagacgctcacgcatggcctgaattttaggctgcagcatacgcatcttcgccatggaggtgtactgcgctttggtcagcgggtacatgatgccacgaacgataaaggtaataacgatgatggagaagccccagttacccaggaagctatggatccatttcagcagtttgaacagcggctgagagatgaaccacaaccagccgtaatccacggtcagatcaaggtgcggcgcaacagcagccattttgtcctgaatttccggacccacccacagggtgctgctcagcgcaccggtttgacccggctgaaccagaaccggcgcagacttatagccgatagcggcaacgccattgcccaggttgttggtgtagaaattgtttgccacgtcgttacgcggaacccacgcggttgcgaagtactgttgcagcatcgcaacccagccgccgtttgcggtgacgttcaggttttcgttgtcggcaatagtatcgaatttatatttttcgtacttctcatctggcgtggagtacgccgcgccacggaaggtatgcagcgcaaagttgctgcttccggtgtcacgatgagccggcagattgatggattgcttcagctggccgaaggttgccacttccagcggtttcgcgctgctgttctgcacgttgtagccaacgttcaccgcatactcaccgcgtttcagcgtaaaggttttggtgaaggtgttgcctgccgcgtcggtataggtcattgggatcgccagttcgttctggccatccgccagcacaaaggcgtcactggtgacgttatacagcggacgtgcgccgttagccggattatccgggccatcacgacctgtcaggccgctttgtgcctgatagatgaactccggggtggtttccagcaactggaacggctcagaagaacccagttctttcggataacctaacagctgcgcttgttcaacatcaccaccacgggtgttgatggtaagagacagcacatcggtcttaacggtaatcagttttccctggccactggctggtacgccctggtctgcggcgctacccgctgcggtggtcgtagtctgcgtggtctgctgcgcctgaggctgaggatttttatcctgctcccaggcttgccagatcatgaaagacacgaacaacaaagcgatgacaagaagattgcgttgcgaatccatcgttagtgttctctggtattaaaaggtcctggcgggacggggtcgtcgccacccgggtgtaaagggtggcattttaatacgcgtttcaccgtcaaccaactgccttttatcactccaaacctgcgcaatgcctcaattccgtaggccgaacaggttggagtgaaacggcaatgtggcccgagtagcggactaatcaggcgttgataaaccctaataagggctatcaggagccttgagccaggcgacagtggcggcgccataatttttccaacgcttccgagagagcacggttatcgaggtcagcaaccccctttttcgccaccaccacgaaatccattgctgggagttcatgctgacgtaaacggaagctttcgcgcgtcaggcgtttgatcctgttgcgttcatgcgcacgtttaacatttttcttggcgacggtaagaccgatacggggatgccccagcgaattcaggcggccgaggatggtgatttgcggcgtgccagcccgttgtggctgctggaagacgaatgtgaaatgattgggagttaacaagcgtaactccctgggaaatgcgagcttaaccacgcagggttagctttattacttggaaacggtcagacgagcacggcctttagcacgacgacgtgccagaacctgacgaccatttttagtagccatacgagcgcggaagccgtgagagcggttgcgcttcagtacagacggttgaaaagtgcgtttcatggcgatttctacctaaacttgaatgatttcactgacttttgcgcctgctcgtttggcaaggccaactgcgtacgcttcagtgttggtgaataaagaggccggattgtaataattgtacactccggagtcaattctctttccttatatcccgcgtattttcgcatgattctgtctgtaaaatgaacagccttaaacgacaaaaatcatacgctgcgcgccgggtggaggattatacgggctggcgacgaaagcgcaaggatcctcaaggatcttcctgagatcaattaagcaaaattttggcgttgctcagcatattttccaatatgcaggctaaatcctgccgcaccctgccaggatcgtttacacttacccggttcggatcgacctgtggataaatggtgaagaatctgtgagaaacacaagatctcttcggctgtttacgttatgatccgcggtcccgatcgcgatcctcgatcgtaaaaagggacaaatcgcaaatagcggttcgcacgtcacccttcaggggtctttcagagaccttttcgacgtgtgtcaacaatcatgaatattcagcctttgtcattttatcgactttgttcgagtggagtccgccgtgtcactttcgctttggcagcagtgtcttgcccgattgcaggatgagttaccagccacagaatttagtatgtggatccgcccattgcaggcggaactgagtgataacacgctggctttgtatgcgccaaaccgttttgtgctcgattgggtaagggataaataccttaataacatcaacgggctgctcaatgatttctgcggtactgatgtcccccagctgcgttttgaagtgggaaccaaaccggtcacgcagaccgtcagggagacggtgaacgtcgccgcgcccgcgcaggtggcggcggtgcataccccgcgccccgcgcccgcacgctcaggctgggataacgtcccggctcccgcggagccaacctatcgctccaacgttaacgtcaaacacacctttgataacttcgttgagggtaaatccaaccagctggcccgcgctgcggcccgtcaggtggcggataacccaggcggcgcgtataacccgctcttcctttatgggggaacaggtctgggtaaaacgcacctgctgcacgcggtaggcaacggcatcgtggcgcgtaagccgaacgccaaagtggtgtatatgcactccgagcgttttgttcaggacatggtaaaagccctgcaaaacaacgcgatcgaagagtttaaacgctactaccgctccgttgacgccctgctgatcgatgacatccagttctttgctaataaagaacgatcccaggaagagtttttccacaccttcaacgctttgctggaaggtaatcaacagatcattctcacctcggatcgttatcccaaagagatcaacggtgtcgaggatcgtctgaaatcccgcttcggctgggggttgaccgtcgcgatcgaaccgccggaattagaaacccgtgtggcgatcctgatgaagaaggccgacgaaaacgatattcgtctgccgggtgaagtggcgttctttatcgccaagcgtctgcgctcaaacgtacgtgagctggaaggcgcgctgaaccgcgtcattgccaacgccaactttaccggtcgcgccattactattgatttcgtgcgggaagccctgcgcgatctgctggcgttacaggaaaaactggtcaccatcgacaacattcagaaaacggtggcggagtattacaaaattaaagtggcggatttgctgtccaaacgccgctcccgctcggtagcgcgtccacgccagatggcgatggcgctggcgaaagagctcaccaaccacagcctgccggaaatcggcgatgcctttggtggccgcgaccacactaccgtgctgcatgcctgccgtaagatcgagcagttgcgtgaagaaagtcatgatatcaaagaagacttttccaatttaatcagaacattatcttcgtgatgcgatgaaagtgacgctatgaaatttaccgttgaacgtgaacatttactcaagccgctccagcaggtcagcggcccgctgggtggtcgtcctacgctgcctattctgggtaacctgttgttgcaggttgctgacggcgcattgtcgctgaccggtaccgatctggaaatggaaatggtggcccgcgtcgcgctgctgcagccgcacgaacccggtgcgaccaccgttccggcgcgcaaattctttgatatttgccgtggcctgccggaaggcgccgagatcgccgtacagctggagggcgaccgtatgctggtacgctccgggcgcagccgtttctcgctgtcgaccctgccggcggcagacttcccgaatctggacgactggcagagcgaagtggaattcaccctgccgcaggcgaccatgaagcgcctgatcgaagcgacccagttttccatggcgcatcaggacgtgcgttattacttaaacggtatgctgtttgaaaccgaaggcgaagagctgcgcaccgtggcgactgatggtcaccgcctggcagtctgttccatgccggtcgggcagtcgctgcccaaccattcggtgatcgtgccgcgtaaaggcgtgatcgagctgatgcgtatgctggacggcggtgattcgccgctgcgcatccaaatcggcagcaacaatattcgcgcacacgtcggcgattttatcttcacatccaagctggttgatggccgtttcccggattatcgccgcgtattgccgaagaacccggacaagcatcttgaagcaggctgcgacatcctgaagcaggcctttgcccgcgcggcgatcctctccaacgagaaattccgcggtgtacgtctttatgtgagccagaaccagatcaaaatcaccgccaataaccctgagcaggaagaggcggaagagatcctcgacgtcacttacggcggcacggatatggaaatcggctttaacgtcagttacgtgctggatgtgctgaacgcgctgaagtgcgaaaacgtccgcattatgctgacggattcggtttccagcgtgcagattgaagatgcagccagccaaagcgcggcctacgttgtcatgccaatgagattgtaatgtcgctcacccgcttgttgatccgcgactttcgcaacatcgagagcgcggatctcgctttatcccccggctttaacttcctggttggcgcgaacggcagcggcaaaaccagcgtgctggaggcgatctacaccctcggtcatggccgggcgtttcgcagtctgcaaattggccgcgtcattcgccatgagcaggagtcgtttattctgcacgggcgtctgcagggcgaggagcgcgaaaccttaatcggcctgaccaaagacaagctcggcgatagcacagtgcgtatcgacggcaccgacggccacaaagtcgctgagctggcgctgctgatgccgatgcaactgattacgcccgaggggtttactttactcaacggcggccccaaatacagaagagcattcatcgactggggatgctttcacaatgaagccggattctttaacgcctggagcaacctgaagcgtctgctgaaacaacgcaacgccgcgctgcgccaggtgagtcactatgcgcagttgcgcccgtgggataaggagttgatcccgctggcggaacaaatcagtcaatggcgcgccgaatacagcgccgccatcgctgaagatatggcggatacctgcaaacagtttctacccgaattcaccctgagcttctctttccagcgcggctgggaaaaagagaccgactatggcgaggtgctggagcgtagcttcgagcgcgatcgcatgctgacctacaccgcgcacggcccgcacaaggcggatttccgcattcgtgccgacggcgcgccggtggaagatacgctctcacgcgggcagttaaaactgctgatgtgtgcgttgcgtctggcgcagggcgagttcttaacccgtgaaagcgggcgacgctgtttatacctgatagatgattttgcctcagagcttgatgacgcacggcgcggactgcttgccagccgcttaaaagccacgcagtcacaggtctttgtcagcgccatcagcgctgaacacgttctggacatgtcggacaaaaattcgaagatgttcaccgtggaaaagggtaaaataacggattaacccaagactaaatgagcgagaaacgttgatgtcgaattcttatgactcctccagtatcaaagtcctcaaagggctggatgcggtgcgtaagcgcccgggtatgtatatcggcgatacggatgacggcaccggcctgcaccatatggtattcgaggttgtggataacgctatcgacgaagcgctcgcgggtcactgtaaagatattgtggtgacgatccacgccgataactctgtctccgtaacggacgatggccgtggcatcccgaccggtattcacccggaagagggcgtgtcggcggcggaagttatcatgaccgtactgcacgcaggcggtaaatttgatgataactcctataaagtgtccggtggtctgcacggtgtgggcgtatcagtggttaacgccctgtcgcaaaaactggagctgctgatccgtcgtgaaggcaaaatccaccagcagacttacgtgcacggcgtgccgcaggcaccgctggccgtcaccggtgaaaccgacgctaccggtacgcaggtgcgtttctggccgagccatgaaaccttcaccaacgtcgttgaatttgaatatgacatcctggccaagcgtctgcgcgagctgtcgttcctgaactccggcgtctccattcgcctgatcgacaagcgtgacggtaaagaagaccacttccattatgaaggcggcatcaaggcgtttgttgaatacctcaacaaaaacaaaacgccgatccaccctaatgtcttctatttctccaccgaaaaagatggtatcggcgttgaagtggcattgcagtggaacgatggtttccaggaaaacatctactgctttactaacaacatcccgcagcgggatggcggtacgcacctggctggcttccgtgcggcaatgacccgtaccctgaacgcctacatggacaaagaaggctacagcaaaaaagcgaaagtcagcgccaccggcgacgatgcgcgtgaaggcctgattgctgtggtatcggtgaaagtgccggatccgaaattctcctcccagaccaaagacaaactggtttcttccgaggtgaaatcggcggttgagcagcagatgaacgaactgctgtcagaatacctgctggaaaacccgaacgacgcgaaaatcgtcgtcggtaaaatcattgatgcggcgcgcgcccgtgaggctgcccgtcgcgcccgtgaaatgacccgtcgtaaaggcgcgctggatctggccggtctgccgggcaaactggcggattgccaggagcgcgacccggctcactccgaactgtacctggtggaaggggactctgcgggcggctctgccaagcagggacgtaaccgtaagaaccaggcgatcctgccgctgaagggtaaaatccttaacgttgagaaagcgcgtttcgacaagatgctcgcctcgcaggaagtggcaacgcttatcaccgctctcggctgcggcattggccgtgacgagtacaacccggacaaactgcgctatcacagcatcatcatcatgaccgatgcggacgtcgatggctcgcacatccgtacgctgctgttgaccttcttctaccgtcagatgccggaaatcgttgagcgcggccacgtctacattgcgcagccgccgctgtacaaagtgaagaaaggcaagcaggaacagtacatcaaagacgacgaagcgatggatcagtatcagatcgctatcgctctcgacggcgccacgctgcacaccaacgccagcgctccggctctggctggcgagccgctggaaaaactggtggctgaattcaacggcgcgcagaaaatgattggccgcatggagcgtcgctacccgcgcgcgctgctgaaagagctgatctatcagccgacgctgacggaagacgatctcaccgacgaagcgaaagtgacgggctgggtgacgcagcttatcaacacgctcaatgaaaacgaaatgcacggcagcacctggaacgtcgcggtgcgcgagaacgccgagctgaaactgttcgagccggtcgtgcgcgtacgtactcacggtgtggataccgattatccgctggagcaggagttcattgtcggtggcgaataccgccgtctgtgcgcgctgggtgagaaactgcgcggtctgatcgaagaagacgcctttatcgagcgtggcgaacgtcgccagccggtggccagcttcgagcaggcgctggactggctggtgaaagagtcccgtcgtggtctgtctatccagcgttataaagggctgggcgagatgaacccggagcagctgtgggaaaccaccatggatccggacagccgccgtatgctgcgcgtcacggtgaaagatgctattgccgccgatcagctgttcacgaccttaatgggcgacgccgttgaaccgcgccgcgcctttatcgaagagaacgccctgaaagccgcgaacatcgatatctaagccgtttgtcccaggtggcgcgttgcttaccggggctacagcagcatcaggcccggtaagcgtcagcgccaccgggcttttttttggccgcaaaaggaggatcctctccccggactccatccccctttcttaccgtgttttttcggcagaatcgcgttagcatgcgttaagactcatttactgcggggaactcatggctatcaaactcattgcaatcgacatggacggtacattgctgctgccggaccataccatttcacctgcggttaaaaatgccattgccgcggcgcgtgaaaagggcgttaacgttgtgctgaccaccgggcgtccttatgccggggtacacaactacctgagagagctgcacatggataagccgggtgattactgcatcacctacaacggcgcgctggtgcagaaagcgagcgatggcagcacagtggcgcagaccaccctgagctacgacgattaccgctatctggaacagctgtcccgcgaagtgggctcacacttccacgcgctggatcgcaatacgctctacaccgccaaccgtgacatcagctactacacggtgcacgaatcctacgtggccaccatcccgctggtgttctgcgaagcggaaaaaatggacccggcgatccagttgctgaaagtgatgatgatcgacgagccggccattctggataaagccattgcgcgtattccggcagaagtgaaagagaaatacaccgtgctgaaaagtgcgccgtacttcctcgaaatcctcgataaacgcgtcaataaaggcaccggtgtgaaatcgctggccgatacgctgggcattacgcctgacgagatcatgaccctcggcgatcaggaaaacgacatcgcgatgatcgaatacgccggtcttggcgtggcaatggataacgccattgattcggtgaaagaggtcgcggatttcgtcaccaaatccaatctggaagacggcgtcgcttacgctatcgaaaaattcgtcctgaactgatcggcctgaagacgcaaaacgacatgaaacagatcacctttgccgcacaacaccatcagctgaccaatacccggacctggacgccggacagccagtggctggtctacgacgtgcggccttcgggcgcctcttttaccgggcgcaccattgagcgcgtcaatatacacaccggtgcggttgaggtgatttataccgcccctgagggggcgcatgtcggcgtggtgacggtgcatccggcggcggaaaaatatgtctttatccatgggccggaaaaccccgacgcagagtggcagtacgattttcaccaccggcgcggcgtggtgacgcatgcgggtaacacccaaaatctggacgcgatggacatcaccgcgcccttcaccccgggcgcgctgcgcggcggcagccatgttcacgtttatagcccgaacggtgagtacgtcagctttacctataacgatcatgtcatacatacgctctccccggcgctggatttgcgcaacgttggcgtggcagcgccctttggtccggtggaaccgccgcgcacgcatccgcgggaatactgcggcagccactggtgcgtgctggtcagtaaaacaaccgccacaccgcagcccggcagcgatgacatcaaccgggcttatgaagaaggctgggtggggaacgacgcgctggcgtttatcggcgatacgctgtcccttcgcggggagaaggtgccggagctgtttatcgtcaccttgccgcgcacagaggcggcctggaagcaggcgggcgatcgacctttagccggaacgcccgatacgctgcccgcgccgcccgcaggcgtactgcaaaaacgtctgacctttactcatgaacgggctttcccgggactggtgaacactccgcgccactgggtgcgcagcaatccgcaggcaacttccattgcgtttctgatgcgtgatgagcggggtattgttcagttatggctgatatcgccggagggcggggaaccgcgccagctgacgcacaatgccagtgatattcagtcggcgtttaactggcatccggcaggtaatgcgctgggctttgtgctggaaaaccgcatcgcgatgtgcgacgcgcaatgcggcgacatcacttttttgactaccgatcacgaaaatatcccggccgcagacgcggtggtcttttcgccggacgggcggcatatcgcctggatggaggagacgcagggataccgtcaactgtggttaacggccaccggattgtaaatcagggcgcgacggcgggcgggatcaccgaattggtcgccagattcgcctgctcgcttttctcgacgcgcgagcgaagtgaattatctttgcggaataaatcccagggcagcagcagcgtatccatcaccgccgtaaaaggcatatccagcgccaccagcgatttcatgccgatgctggtgtcatcgtcgccgagcatttttgtgctggcgctggtgccggggtaaagcccctctttgccgccggtatgggacatcacgctggagcaaccgccgatcgacatcatcccgcttacgacagccagtattagaagaatgtttttcataacgatttgatcatagtgagtggccgtacacgcttatagcgatcctgaacgtaaaagagtagtgatggagcgccacactgtggcggtcatcgcaatttaacaatttatgctgtaacccagtctatgcaatgactgcgaaagtgcaaaaaaaagtcagataaacacccttgaaaagaaaatgactgcacccattttaggtaatgtcccggaaagaacacgcctgcggggtgttcgggggccgacaagcctgtccatggtggaaggctgaaaattctcgctgatttcaggagcttatttatgcgtaacttcgatctttctccgctttaccgttctgctattggtttcgatcgcctgttcaacctgttagaaaataatcagacccaaagcaacggcggttaccctccgtataacgttgaactggttgacgaaaatcactaccgcatcgccattgccgtcgccggctttgcagaaagcgagctggagatcaccgctcaggacaatatgctggtggtgaaaggcgctcatgccgctgagcaaaaagagcgtacttatctctatcagggcatcgccgaacgcaatttcgagcgtaaattccagttagccgaaaatatccacgtacgtggcgctaacctggttaacggcctgctgtatatcgatctggaacgtgtcattccggaagcgaacaaaccgcgccgtatcgaaatcaactaattgccagggcacgcccgggcgtgcccgaatcaccttgctcgccgtcagggagcaaatgcctgtcttcatacaggcagatatttactcgcttctcagaaggagaaaaccatgcgtaactacgatttatccccacttctgcgtcaatggatcggttttgacaaactggctaatgcgctgcaaaacacggctgaagggcagtctttcccgccgtacaacatcgaaaaaagcgacgataaccactaccgcatcacgctggcgctggccggtttccgtcaggacgatttagagatccagcttgaaggtcagcgtctgaccattaaaggcacgccggaaaaaccggccagcgagccgaaatggctgcatcagggtctggtcatccagccgttcagcctgggcttcaccctggccgaacatatggaagtggctaacgcgaccttcaacaacggcctgttgcacatcgatctgacccgcaacgtgccggaagccatcgcgccgcagcgtatcgccatcagcgaacgccctgcgctgaacagctaagtctttatcacctctgatcttctggccgggccagcgccatgctgacccggcctgcttgtttctgcttactcccttttgtgcgccaccacccatacagccgcgctgcgctctgcgaaaatccctgtaaataatagtgttattcacaaggatccctttatgagtgagatagcgttaacggtcagtattctggcgctggttgctgtcgtgggtttgtggatcggcaatatcaaaatccgcggtgtgggctttggtattggcggcgtgctgtttggcggcattatcgtcgggcacttcgtcgatcaggccgggattggcctcagcagcgacatgctgcacgtgatgcaggagttcggcctgatcctgttcgtttacaccatcggcattcaggtcgggccgggttttttcgcctcgctgcgcgtatcaggattacgcctcaatctgttcgccgtgctgatcgtcattatgggcgggctggtcaccacgctgctgcataaactctttgctatccctttacccgtagtgctggggattttctccggcgcggtcaccaacacccctgcgctgggagcggggcagcaaattctgcgtgatttaggcacgccgggggatgtcgtcgatcagatgggtatgagctatgcgatggcctatccattcggcatctgcggcattctgctgaccatgtggctgatgcggcggctgttccgcgtcaatatcgaccaggaagcgcagcagcacgagcacagcgccgggaacggccatccgcagcttaaaaccattaatatccgcgtggaaaatccgaacctgaaccgcatggcgatccaggatgtgccggtgctcaacagcgacaggatcatctgctcccgcctgaaacgcgatgacaccctgatggtgccgtcgccgtccacaatcatcaggcacggcgatctgctgcatctggtgggtcaggaagcggatctgcgcagcgcgctggtggtcatcggtcaggaggtggatacctcgctgtccacacgcggcaccgatctgcacgtcgagcgcgtggtggtgaccaacgaaaaagtgctcggcaaaaaaatccgcgatctgcaccttaaacagcgctacgacgtggtgatctcgcgccttaatcgcgccggggtggagctggtggcgagcagccacgccagcctgcaatttggcgatattctcaacctggtggggcggcaagcgtctattgacgcggtggccgccgaagtgggaaacgcgcagcaaaaactccagcaggtgcagatgctgccggtgtttatcggcatcgggcttggcgtattgttaggctctctgccgctgtatgtgccgggatttccggtggcgttaaagcttgggctggcaggcggaccgctgattatggcgctcattctcgggcgaatcggcagtatcggtaagctgtactggtttatgccgcccggcgccaacctcgcgctgcgcgaactgggtattgtgctctttctggcggtggtcggcttaaaatccggcggcgattttatcgacacgctgatcaatggcgacggccttaactggatgggctacggcatccttattaccgccgtgccgctgatcgccgtcggcctgctggcgcgtatcttcaccaaaatgaactacctgacgctgtgcggcatgctggccggttcaatgaccgatcccccggcgctggccttcgccagtggtctgcacgccaccagcggcgcggcggcgctctcctatgccaccgtctacccgctggtgatgtttctgcgcatcatcaccccgcagctgctggcggtactgttctgggggataggttaagcgtcagcggccacgccgcaggtggtaatccacctgataatcgctggcattgcggtacatgatggaataattaagaaacacgccgctgtcgctgtaggacagcgacgtgatccgcaataacggcgtatcgcgagctaccttcagtagtctcgacatctccccgtccgccagcaccggcgtcaggctctcataattcccgctaatatctatcccgcagtttttttcgatgtagtcgaatttcgatccctccagatgcaccagcgccaggtcgtgaaacagcttcaccggcatatagctgtcttccagcagcaacggcgcgccatccacatagcgtaaccggcgtgaatagtagatgcgttcattgatttgcagacgtagctgactggcaatcgcgggtggggcgggcatcacttcgaattcaagcacctcgctcatcacgctgcgcccctgcgctttcataatttcgcaaaagccggtgagattgcgggtttcgtggtgcacatcttttttcagcagacgggtgccgctgccgtgccgccgttcaatcagcccctgttcgacaagtacagccagcgctctgcgcatggtcatgcgcgacacgccatactcctgcgccagcgttttctcgccgggcagcacgcttcccgtctgcatctctttttcattcagccgggcacgtaatgtttccgccagcgatttatagatcacttttagacctcttttttgtcattttcattccctgcccgtcagtcaccaggcgtccctgttctgctatcactaccgcattatttatgacatgtctgcttatttccgaaaatatagacaggtgcaccgaaataaaatcctgtgcagcatcacaaaataattatttattaaataagcgccgtgtctgccctgctttatgattattgcagttatccattatcagcccttccggaagttatatgcaatatttataaggattatgaaaatgctgagtcaaatacaacgctttggtggcgctatgttcaccccggtattgctatttccatttgcagggatcgtcgtcggtttagcaatattattgcagaatccgctttttgtaggcgaagcattaacatcgcctgattcactctttgcacaagtgattaatatcattgaagaaggtggctggacagtattcagaaatatgccgttggtttttgctgtgggattacctgttggcctcgcaaataaagcgcaggcgcgggcgtgtttagccgtactgattagctttatgacatggaattattttattaatgccatgggtgtagcctggggcgcttttttcggcgttgactttagtattgatgctgttgccggaagcggtttaaccactattgccggaattaaaacgctggataccagtattattggcggaattgtcattgccggtattgtaacggcgatacataaccgctatttcgataaacccatgccagtatttttaggtgtttttcagggcacctctttcgtggttatcctggcgtttttaatgatgctgccctgcgcatggttaacactctggggctggccgaaagtgcagtttgggattgaatcattgcaggcttttttacgcagcgccggggcggcgggcgtctgggtgtataccttcctggaacgcattctgatcccaaccggattacaccattttatttacggcccctttatgttcggcccggcggcggtagaaggcggtattcaggtgtactgggccaaccatttgctggaattcagccagaccactacgccgctgaaaacgctctttccggaaggcggattcggcttattcggtaattcaaaggtgttcgcctcgcctgggattgcgctggcgatctactacaccgccgccgtacataatcgcaaaaaaatcgccggtctgctgatcccggcagtattaacggcggtgctggtgggcatcaccgaacccctggaattcacttttctgtttatctcgccggtgcttttcgccatccatgcggtgctggcggcgaccatggcgacgttgatgtatatgggcggcgtggtgggaaacctgggcggcggcttccttgacaccatgctgccccagaactggatcccgatgtttaacaatcatgccccgatgatattcacgcagctcggcatcgggttgagttttaccgcgatctactttgtggtgtttcgcacgctgattttgcgcttcaacctgaaaacgccgggacgcgacgacgcggaaattaagctgtacagcaaagcggattacaaagcgttgcaggcgcaaaccccgacggcagagaaaaatccggccgcggcttacctcgcggccctcggcggcgcgggcaatattgcaacgcttaacaactgcgccacgcgtctgcgcatcacgctggtcgacatggcgaaaacgcacagcgacgacgttttcaaagccctcggcgcgcacggcgtggtgcgcagcggcaacggtattcaggtgatcatcggtctgcacgttccccagttgcgcgatcagctggaaagcctgatgagagtccctttatcaaaccaaccttcccccatgacagaggtcatatcatgaaaaaattctcggttgttattgccggcggcggcagcacctttacgccaggtatcgtgttgatgttactcgctaatcaacatcgcctgccgttacgggcgctgaagttttatgacaacgacggcgcgcggcaggaggtgattgccgaagcctgcaaaatcattctgcgcgagcaagccccggacatcgatttttgctacaccaccgatccgcaaaccgcgttcagcgacgtcgattttgtgatggcgcatatccgcgtgggcaaatacccgatgcgcgaaaaagacgagaagatcccgctgcgccacggcgtggtcggtcaggaaacctgcgggccgggcggtattgcctacggaatgcgctccattggcggcgtgctggagctggtggattatatgcagacctggtcgccggacgcctggatgctgaactactccaatccggcggcgattgtcgcggaagccacgcggcggctgcgcccgacggcgaaaatccttaacatttgcgatatgccgattggcatcgaaggacgcatggcccaaatcctcggcctacaagaccgcaaacagatgatcacccgctattacgggctgaaccacttcggctggtggcatgggatagaggacctggacggtaacgatttaatgcccgcgctgcgccagtacgtgtctgaacacgggtatattcctccgtcaaatgacgagcatacggaagcgagctggaacgacaccttcgccaaagcgaaggacgtgcaggcgctggatccggctacgctgcccaacacctatctgaaatattatctcttcccggattatgtcgtcgcgcacgctaaccccgggcgcacacgggcaaacgaggtgatggatcaccgtgaaaagcacgtgttcagcgcctgtcgcgccattattgaggccgggcattccgcagccggggagctggaaattgacgaacacgcctcttatatcgtcgacctggccgccgccatcgcctttaacacccaagagcgcatgctgctgatcgtgccgaacaacggcgctatcgccaatttcgatgccgacgcgatggtggagatcccctgtctggtgggcaaaaacggtccggagccgctgacggtcggcactatcccgcatttccagaaagggctgatgagccagcaggtggcggtggaaaaactggtggtcgatgcctgggagcaggggtcatatctgaaactgtggcaggccatcacgctctcaaaaactgtaccgagcgcctctgtcgccagagcgatccttgatgacttaatcgaagccaataaagactactggccgcgattaagttgatcctgccgggccggtattgttctgatgccggcccgactgcgcaagcgcctgcgatggcgcatagccaaagcgctgcttaaacgccttactgaagtgaaaagaatcaaagaaattaagcatatccgccaccctgctgacgctgtttccctgctgttttaacagcgacagcgccagatccagacgcgcatgcagtgcgtactcttttggcgttttgccggtataacgcagaaacaggcggcgcagataaggcgcgctgcactgcatgcgctgcgccatttcattcaccgtccagcgctgttgcggcgccgcatgcagagcggtgatcagtttttcaaattgcacttgctgtgcgtctttggtgcccttttcggcgatcagacaaatccactgatatatcatcttggtcagaaatgccaccgccagattatttttcattgcatcgccactgcgtgttaataaagcgacttcattaagctcgtgattaaatagctcgccattacagataacgccttgctgtaataatggtatttccattaaggtggtgggaataaactccatccagtattgctcccacagcaatcccgcacagtgataagattttatatccgtcggttttaaaaatataacgcaattgccgttaagaataatttcagcgtcgtcgcgcaaaatgatttttccgcagccctgcaacgtataaaccgccacccatgaattggcgatcaacggctttttcttatcgcgcggccagtaaacgcggtagctttcatcggcgagggtatgccataaggcgatcagtgaaataccgctggagatcacactttcatcaagaaccaacggaatattgtacgtgggttcgttttttacatgcgagttttgcaattttccattcattttaaattcccgccgcagaatgatgtccacaacctgaacgtaccagaaaataaatcgctcggggatctgaagtttgtattttaagaaatctgactgcctgacccggctcgccgggacataatgaaaataaggctacgagatgaatacgctacaaattctgagctttgtcggttttacgctactggtcgcagtaataacctggtggaaggttcgcaaaaccgacaccggctcgcaacagggttattttcttgccgggcgatcgctgaaagcgccggtgatcgccgcgtcgctgatgctgaccaatctctccaccgaacagctggtaggcctgtccgggcaggcataccggagcggcatgtcggtgatgggctgggaagtgacttccgccgtgaccctaatcttcctcgcgctgatattcctcccgcgttatttgcagcgcggcattgccaccattcccgattttctggaagagcgctacgataaaacgacgcgcattattatcgatttctgttttctgattgctaccggcgtctgcttcctgccggtcgtgctctattccggcgcactggcgctgaacagtctgtttcatgtcggcgactcgctgggtatttcgcagggtgcggcaatctggctgctggttattttacttgggctggcgggtattgtttatgcggtgatcggcgggctgcgcgcgatggcggttgccgattcgataaacggtattggtctggtcattggcggtctgctggtgcctgtttttggcctgatggcgatggggcacggcagttttctgcgtggcgttgaacagctcaccacccttcatgcagaaaagttaaactcgataggcggggcgtccgatccgctgccgattggcgcggcattcactggcctcatcctggtgaacaccttttactggtgtaccaatcagggcattgtgcagcgcacgctggcgtcgaaaagtctcgccgaagggcaaaaaggcgcgctgttaacggcggtgctgaaaatgctcgatccgctggtgctggtattgccgggcctcatcgcttttcacctctatcaggatttacctaaagcagatctggcctatccgacactggtgaacaatgtgcttcccgtaccgctggtgggattctttggcgccgttttattcggcgcggtgatcagcacctttaatggctttttaaacagcgccagcaccttattcagtatgggaatttatcgccggatcattaatcaggacgccacgcctgagcggttagtgcatatcgggcgaaaattcggactcgttatcgccattatttccgtgctggtcgcaccctggatcgcccatgcgccggaaggcttatacagctggatgaagcagctcaacggcatctataacgtcccgctggtgacgatcatcattatgggctttttctttccgcgtattccggcgctggccgcgaaggtggcgatggggctggggatcgtcagctatatcaccatcaactatctggtgaagtttgatttccacttcctgtatgtcctcgcctgtacgttctgcatcaacgtggtggtgatgctggtcatcggcatcattaaaccgcgcgccacgccatttcagtttcaggacgccttcgcggtggatatgcagccgtggaaaaacgcccggattgcctccgtcggcatactgttcgcgatgatcggcgtctattccggcctcgcgcagtttggcggctatcacacccagtggctgatgatcatcagctatgccattaccgccgccgtggttatctggttgatttacagcacgatgacaacggctaaaggtgcctctggcgctaaggataacgcatgaaccgccccaactttttgttcattatgaccgatacccaggccaccaatatggtgggctgctacagcggcaagccattgaatacgaataatattgatcggctggcagaggaggggatccgctttaactcagcctatacctgtgcgcccgtctgtacgcccgcccgtgccggtctgtttaccggcatctattccagccagtccgggccgtggaccaacaacctcgcgccgggcaacaacatcgccaccatgggacgctactttaaagaggcgggctaccacacctgctacatcggcaaatggcatctcgacggacacgactatttcggcaccggcatctgcccgccggaatgggatgcagactactggtacgacggcgcaaattatctggcggaactgactgaccagcagatcggcctgtggcgcaacgggctgaacagtattgaggatctgcgggcgaacggtatcgatgaaacctttacctgggcgcaccgtatcagccatcgtgccgtcgattttttacgccagcctgtgcgtgacgagcagccgttcctgctggtggtttcctatgacgagccgcaccatccctttacctgtccggttgagtatctggaaaagtatcaggacttttattacgagctgggcgacaaggcgcatgacacgctggaagacaaacctgaacatcaccgcctctgggcgcaggccatgccgtcgccagtgggaagcgatggccgctatcatcatccgctctattttgcctgtaatgattttgtcgacgaccagattggccgggtgatcgatgcgctcaccccacagcagcggcaaaatacctgggtgatttatacctccgatcacggcgagatgatgggcgcacatcagctcatcagcaaaggggcggcgatgtatgacgacatcacccgcatcccgctgattatgcgcccgccgcagggtacgccgcaccatgtcgatacgccggtcagccatattgatgtgctgccgaccatgatggcgctggcgggaataaacaagcccgccattctgcccggcgaaaacatcctcaacggcctatctgagcgtggcgtgatggtggagttcaaccgctatgaaattgaacatgacagctttggtggctttattccggtgcgctgttgggtgaccgatcgctacaaactggtgatcaatttatttaccagcgatgagctgtatgacagagcgaatgacgccagtgaaagggtgaatctgattaacgatccgcgctatgccgctgtccgcaatcagctgcatgatgcgctgctcgaatacatggacaccatccgcgatccgttccgcacatatcagtggcgacaacgcccgtggcgacaggatgcatcgccgcgctggatgggcgccttccgtccgcgtccggacgatggccattcgccggtggtgcgcgattacgacaccggtttgccaacccagggcgtgaaggtggaagagaaaaagcagaagttctgacgggttattgccgggtggcgcatacgcttacccggcctacaaagttataccgtaggccggataaggcgtttacgccgccatccggcacctttaatagtgccctacagcctgcacctcagctagaattggcgttcatccgtttaatcagggaaggagccgttatgaaaatttcccgcctcggcgaagcgccggattaccgcttctcgctggccaatgagcgtacctttctggcctggatccgtaccgcgctcgggtttttagcggcgggcgtcgggcttgaccagctcgcgccggattttgccacgccgctgatccgcgaactgctggcgctgctgttgtgcctgttcgcaggcgggctggcgatttatggatacctgcgctggctgcgcaatgagaaggcgatgcggctgaaagaagatctgccctatacccgtacgctgctggtaatcagcctcattctgacgcttgtcgccgccgtggtgatggtgctggtgttttatgccggatagccgcaaagctcgtcgccagcaggatcccggcctgcagccggagcgcacgtcccttgcctggtttcgcacgctgttgggctacggcgcgctgattgcgctggccatcagacatcactggtatgaatcagggataaccttctggatctcgctggcggtgctggcgctcaccgggctgatcctctggcgttacacccgcaggcgtaacctgatggatgtcagccacagcgactttgtgcaaccggcggcgttacgggataaattcttcattgcgctggcggtgctggcgctttccctgctgttcgcgagcgcgcatatccgccaggtattgttagtgatcgcagaatagttgtagcctgcctgtgctcacccctttaccacaccatttcatgcagggtttatcgtgactaaaaccgtgatcgccagcgcattactctttgttgccagcgccgcttatgccgcgccgccgctgacggctgcccgttacgccgcacagctggggccgggtatggaggtggactgggcgcgtactgaacgcggcatccgtgaattcgacccgctggtggtcagagattttgcggcgctgggtattcatcacgtgcgtattcgcgtggcgcagaacatgaccgaggcgcggctggtgcacctgcgtaaactggtggaggcgtgcgagcagtacggcgttatcccgatcatcgcgtatcaggccgacggcctgaaggccgatccgctgaaaaacgaggcggcgttagtggcgtggtggagtcgggtggcgcgctattttggtactgaccatccgctgcttggctttgatctgatcgatgaaccggcggaaaagctcaatcgcgatcaggcggcgctgagccggatttatgaccgactgatcaaaaccctgcatggcatcgacccccggcgcatgatttttgtcgcgccgcgcctgcggtcagcgccggaagcgctgactgagctgaagctgccgccgcacagccagaattacgtgctggcgcagtggcatatgccgggcgcagggccgcaaaaaaataacggtaaatactcaccgacgcctgccgggaaagccgccattcacgcgcacatcaatgcggtgctgcgctggcagcagaaaaccgggcacgtcagctgggtgggaagctgggcggtgggtgaagccagtaaaagcgcgccgacggccgcacagctcgccttcgccacctttacggcctgcgagctgaagcgggccaacattccttatgcaatcaatgccgacgcccggttttacgacggggaagagggcgcgtggcgtcctgaccccgcgccgctgttaaaaacgatgatcgccccggcgtgtgacgctaaaccgccgtttcatgatgggcaaagcgcgacgccagcggcagccagcacaacaggatcagcagccccatcagcgtcatcagcatcccgaggctagcctgcccgttctgcggcagcatggcggacagccaggccagcacgccggagccaatattttgcaggccgcccaccagcgctcccgccgtgcccgccagaaacggaaacggctccatcgcgccgctggtggcaagcgggaacagcatccccgcgccgaagaaaaacagcgccgccgggatcagcagcgtccagacgttcatcacgccaaaccagccggggatccacatcatcagcccggcgagcagacagcttgccaccgcctgccacatcagcgtggaaaagcgtttgttctgccgcccggcaaaccatgcgccgaaaaacgccgccgggatcggcagaataaacagaatgctcaccaccatactgctgaggcccagacccgcgccgagcagcacgccggaacaggcttcaaataccgcgatccccgcaaggccgccaatcagcatcagcagataacaggtaaatgacccgttgccgaacagcgttttgtagctggcgataagccgggtgcgcggcgcgtccaccggacgggtttccggcatccagcgcgccatgctcagggtaacgccgatgcacagcagcagtaaaaagccgaagcatgcccgccagtcccacagcgtattaagcagaccgccaatcaacggcgccagcagcgggctgaccagaatgcccatgttcagcagactgttcgcctggcgaagctgcgaaccggcataaagatcgcgcggcagggtgcgcgccatcacgccgccgacgccggtacccatgccctgtagagcgctggcaataatcagcaccgtcaggctgggggcggcgatcgccattaccgtggcgagcataaaaatggacatcccggcgaggatcaccggacggcggcccacccggtcggcaagcgggccataaaaaagttgtgagacgccgtaggtcagcaggtaggccgccatgacgctctgcaccgcgccttcccgcacgttaaacgccagcgccatatccgcaatcgccggtatatagatggtctgcgccatctggccgaccgccactaacaacaccagcatcattaacaaattaacgtttctgtcccgtttcatgtcgcgtaatactttatcagattgagaaaaaggagaataaaagcctggtcaggccgctgaatgcgagaggaatctaccacagcgcccggcggaagcaatcatgcatggcgtgaatgaaagaaggatgacagcgggaaaatgtaaagaatttgtggcaacaaatattgccagtttaactcaggcgagacgcagtaaaatggcccccagcgcgatgccgcaggcggcagcgatacgcatcccggaaactttctctttgagcagcacaaaggcgatgagcgcgccaaacaaaatcgaggtttcccgcagcgcggcgaccaccgccagcggagcctgggtcatcgcccacagcgccagaccgtaagagcccatggtgccgaggccgccaaaaatcccttttttccagtttgtacgcaggtagcgcgacgcctcccggcggcgggcgatcatcgcccagaccagcaggcaggcgccgttcatgaaaaaggtccacagcgtatagccaagcgcggtgccggataagcgcacgccggtgccgtccaccagcgtgtaaccggcaataaaacaggcgttgatcagcgccagcgcaatgcctttgcgcgaactggcgcgaccgttaaacgccatgccaagtatggcaaggcagatcaccgcgatgccgacccaggccatcgtcgacagatgctcgcccagcgccagtacgcttaccagcgccaccagcagcggggcagtgccgcgcatcagtgggtaggtctggctcatatcggaaacctgataggttttcgccaccagcacggtgtacaccacctgtaacacgcaggaaagggcgagatagggcgcgctggcccatgccggttgcggtgagaagggcagcagcactaaggcgatgagcgccgccgatccgctgacgctgatcgccgaaaaaagtttatcacttcccgccttaacaatggcgttccagctggcatgtaacagcgcggcaaacagcaaaatcaggaaaacggagagtgtcataacaggggcgaccggaggaaatgtaataaaaatgtaacacatattgcgcgggatgccagcaggctgtggttgaagcagaaggtgaaagaggggcggttgcccgcccctcttcggtgcggcttgaacctgaattaccggagtaatttcaggatggcatcaagcagttgcaacaacgcaacaatgagtttcaggatcagaactaccatatccactccgctcatacgcttctccttatggcgtaaggagtacgtccggctggcttacctttccgctgcctgtcaccagccgtttttcacacgctgtcgctccgttggcctgggggcaggcatggcgaaacgaggttgtgtgtgttggcgtatcacagtgtgcactcccggggttaaggcactgacggcaccacccgtttcagccaggactcattcgcgcccgacaaactagcagccccgtatcgcacactctgaaaacataaccagtatagaaaaagactgtatgcatgaacagtattttttggacgaaatgcgatctttgaccgatactcatattgcgcaaaattgcgcctgttgccgattcaacatatactgtgagagttgacgtagcacagtgtgttctgcggcccaccactccgcaaacgctcgataaaacctcatcgcacaaacctgttttgtgccaggggtttaaaagaataacggccctcatgcagggccgttttcttttgcgaagcgctaatcctcatccctgtcggtgtccttaccgtaccccagcgccaggctgtggctgggatcaaaaagcgacaaactttccacctgatcgagcaaaatcaccttacgaaaatgaaaggccgaatgcggctccgacgtcagggtaatattttgccgcgcatagagcgcgctgtagttattttcgatcttcatttccgcgcttttagcatcgcggtagccagtaagcatcgggatcagcacgatgttattgaaggaatcgccgtccaccgtggcggtatggatcataccgatgtacacgcgctgagatttcagcgtcagccacaccagctgcccggtttccatgcactgaaagagcaacccttcaatgccattagcccgcgacagatgcttatagagattctttctgccagcgctgtcgagattagcgctgcgcgcccagttcgaacggtacaggcaaaacagaatggcgaagaacagcatgatcactaccggggcctggatgccaagaaaggtccagttcataaaggtcatctgatagcggtgatcttcgctgccgaacagctccggcagggcgttcatcgataccgacgtcagcagcagtccgagccagacgatggccgtcgctatgatgccctgtaagacaaaaatgcagccgtacagcgccaccagaaaatagacatcccaaccgaaggtacggcggaatttcagacgtgtagacaggtcgcggctggtgtaccagtaaccgcacaccatcaacaccataaaaatagccgttcccatcctatacccttttcagtgcttcaacgtgccgggcaaaatcctcgaccactgccggacaattgatattcacgctggcgttgccgtcctcatcaatgatgatgcgctccccgtcctcaatcgattcctgcaccttgttgcggtcgataacgttaagaagcctctcggggctggtaaagagtttatgtagagcattaaacatacgctttctcttgtgactgtaatgaattaactgcttttaatagtagtcgtgatggctgatgatgaccgttgcaaaagtgtgggaaaacctttcagtgcgtgaatgagcagcgagatagggtacgttcatgtcgaaaaaaatggattttatcgacatgactgcgtgacatgtcgatggtatcaaggtggttcagaaaaattcataaacatacgaatattacattagcatgattttttaaaaggaaactatatagttattgccagtttttatgctggcaatattaatctcaaaattcatcaggcagtcgagcgttcgttccatgaatctgtatactggatattaccatcaacaatgcgccaggtaattttctcgtatcggagttgaacattttccaggtgtccagtcccagggcaatctctggtgtcatgcataaccggtgtaattgaaatgatcttcacatcttccataaaaatattaaaatattcgacctcttggcccgcatcgttaatattataaaactttaactcggcattttgtagcgtctgaccggtagcaacggctttgtaaagataaggcgatgatgaatcaatagctttcgtcagactaaatggtgaatgttggcgcgttcctgtcaacgcgcccgtagcagtatcgttgggaatacagaggttatgaatcagatctctaagttctatactgccttcgcgaccagcaacatctgaaccgccacgtatcattgccccgctatcgtctttcaaaaagaggtgaaccggtacagccattttaacgctccttgttagtctctggtaccattggcgacaagattaatgataggcatcactgcgatgccatctgtgtagaacaaatctgaattcgtgaaactgtaaacttttccggtaatttttatgtttaccgtattcccataagctgaggccgtaactgcgggagtgtttgtctcaaggaatggtgaacgttctcttaatttttccatgatgtcgatatttccttcatctttatcaagataaaaacgataaatatccgaaacggaggcgttcccctcatcgtattttgtgacatataaacagatactatctgataattttttcttacttataaaaatatcgtgaggtggagtattataaaaatattggcaagcgacgtagccactaacgagcattaataaaattactgtaagcacaccgtgcatggatctaataaccgatctttcttgcataatctattccttgttttacccaaaattgatcgcgtggatcgtcaccatatggcggcttgtgataccagtggccccattctttcctgttagtttttgctctttcctgcgcaaagccagcccccatgagtaaaattttttctgggattcctgccgcatagccagttgctccatagtgaaagttgccaaagttttctaattctggatgctgttgcttatagtcccatggtccgcgatttctgacttgcatgtagaaccaggtataagtgagaggagttgccatatcgcgagacataccgtgtgtacgcgctatgcgcatgttatttctaaccagcgatattccctgcgcagggagtaaaggtataacagccatgttaacctcttcttttataagctattaaaaatcatacctcccggacgctcgcttttaatatggcggtagtcacataaatcatttcaagggcgaccacactccattagccaggtggcagaaaatcgtgatcattcacgcattttcaccccccgccgcacaaaaccattgtcaccggcggcatcctgtgcttgtatgaatcctgttaaaaaatgaactgagaaccctaatgcacccatccatgctgacctcgaccctactaaataccgcgccattcgccgcggtggtcgtcgtgcgtgtggtggtggtcgtcggcatcgcgccgtagggtccggaacacacgattccaaaccccgccggcgcaaaccgggcggggttttttattgtgacctccccggaaagtcggcccagaagaacaggactggagcatggcaatttcggacacaacatcacagacaaagcgctttaccggcgcgcaattaatcgttcatttactggagcgccagggcatcaccatcgtgaccggcattcccggcggcaccgtgctgccgctgtatgacgcattaagccagagcacgcagatccgccatgtgctcgcccgtcatgagcagggcgccggttttatcgcccagggcatggcgcgtacccagggcaaaccggcggtgtgcatggcctgtagcgggccgggcgcgaccaacctggtcaccgccattgctgacgcgcgtctcgattcggttccactggtgtgcattaccggtcaggttccctcctcaatgattggcaccgatgccttccaggaagtggacacctacggcatctctatccccatcaccaagcacaactatctggtgcgtgacatccgcgaactgccccaggtgataagcgacgctttccgcatcgcgcagtctggccgtcccggcccggtgtggatagatattcccaaggatattcagaccactgaaatcgaactgagcgagctgcctgagccaggcggcgtggcggcagccccggcctttgaaccgcaaagcgtgcgtgatgccgcgaccatgattaaccgggcgcagcgcccggtgctctatctcggcggcggggtgatcaacgcgccggaggcggtacgcacgctggcggaaaaagctaatctgcccaccaccatgacgctgatggccctcggcatgctgccgaaagcgcacccgttatcgctggggatgctggggatgcacggcgcgcgcagcaccaactttattttgcaggaagcggatctgctgatcgtgctgggggcgcgttttgatgaccgggcgattggcaaagccgaacagttctgcccgaacgcgaaaattatccacgtggatatcgatcgtgcggagctgggcaaaatccgtcagccgcatatcgccattcagggagatgtcggcgaggttctggcggagctgatcccgcaaatcgaggcgcagccgcgcgcggcctggcgcgatctggtggcgcagctgcaacaggagtttccggcaaatatgccggggatggacgatccgctttcccattacggtattatccgcgcggcagcggcctgcgtggatgacagcgccattatcaccaccgacgtgggccagcatcagatgtggacggcgcaggcttacccgctgaaccgtccgcgtcagtggctgacttccggcggcctcggcaccatgggctttggtctgcccgccgccattggcgcggcgctggcgaacccggatcgcaaagtgctgtgcttctccggcgacggcagcctgatgatgaacattcaggagctggccaccgccgcggaaaataatctcgatgtgaaaatcattctgatgaataacgaagcgctggggctggtgcatcagcagcaaagcctgttctatcagcagggcgtgtttgccgccacctatccggggatggtgaactttatgcagatcgccgccggattcgggctctacagctgtgatttaaatggcgaagcggatccgcaggccgcgttgcaggcggcgatttcccgccctggcccggcgctgatccacgtgcgtatcgacgccgaacaaaaagtgtatccgatggtgccgccgggcgcggccaatactgagatggtgggagaataagccatgcaacattccgaacatgacaatgtgatccttgaactcaccgtccgtaaccatcccggcgtaatgacccacgtctgcggcctgttcgcccggcgcgcctttaacgtcgaaggcattctctgtctgccgctacagggcggcgagcagagccgcatctggctactggtcgccaacgatcagcgtcttgagcagatgataagtcagatcgacaagctggaagatgtggtgcaggtgatccgccatcagaccgatcccggcgtgttcaacaaactggggttgtttttcgagtaaaccgcgactcactcactcccgttgccgggagtgagcactttcacgaagccgttacggcaacggtcggggtaatccgccggtaacggcctgtcgctgatcagcacatcaaaagcggcgagcggcgcaatgttcgcctgcgccacctcatcaaaacgcgcatatcgcgcgagcaaaatcttgcgcagcccgcgctccatggctttgcgtttcatcggcagatcgtccgggttaaaccaggtgacgccgaactgcgcatgcacgccgctggccgaaataaacactttgcgtgggttgagtgaatcgagaaccgaggcattcaccggatcgtaaaacgcatcgcttttcgcccgataggtgccgccgcacagcatggcggtggtgttggggcgcgcgttaagcgccataaatacctgatgggaatagcaaataccggtaaaggcgatgtcgtcggggatcatgctgatgaccagcggcatttccgggccgttatcgaaaaacaccacatcgttctcgctcaccagtccggcggcaaggatcgccattggcacatcatcgcggtgatgcccggccaccggcgcggcaggctggctggcagacggggcggcgggcttattcaccatcacgatgtaaccccccagcagcgccagcggcagcggttcgtcatcctggctgaaatcgcgtcgaatcgtcatcagagaaacttccagcatacgcgccgcctccttcagatggatgcgatcggtctttttgagcagctccgtcagccgacgaattcgctctttctgcttggtttccattcactttctccgcaatacaggcctcaacgctgatgttcctaaagtaacattttccccggaaagcgggaataacggcgcgtaaaatgttcctgtaatcgcgagataagtcacaaatgatactaaaataacatgttaatgttacgataatatcattgttatgtgattgtttcagagaggtagtaaaaatggatattgcagtcatcggctccaacatggtggatttgatcacctacacccaccagatgccgaaagagggcgaaaccctcgaagcgccggcgtttaaaatcggctgcggcggcaaaggcgcaaaccaggcggtggcggcggcgaagctcaactcgaaagtgctgatgctgaccaaagtgggcgatgacatatttgccgacaacactatccgtaatctggaatcctggggcatcaacaccacttacgttgaaaaagtgccctgcaccagcagtggcgttgcaccgatttttgtcaatccgaattccagcaacagcattctgattattaagggcgcgaacaaattcctctcgccggaagatatcgaccgcgcggcggaggacctgaaaaaatgtaagctcatcgttttacagctcgaagtgcagctggaaacggtttatcacgctattgagtttggtaaaaaacacggcatcgaagtcttactgaatcccgccccggcattgcgtgaattagatatgtcctatgcctgcaaatgcgatttctttgtgccgaacgaaaccgaactggaaattctcaccggtatgccggttgatcaccttgataatatccggctggcggcccgcagcctgatcgacaaagggctgaacaatattattgtcaccatgggcgagaaaggcgcgctgtggatgacgcgggatagcgacgtgcatgttccggccatcaaagtgaatgcgattgataccagcggcgcaggcgatgcctttattggctgctttgcccactattacgtccagagcggtaatgtcgaagccgccatgagaaaagcctcgcgtttcgccgccttcagcgtaacgggcaaaggcacccagtcgtcttatcccagcattgagcaattcaatgagtttctggcgttaaacgaataataataaaccctgcaacgtaaaaggtagcactatgaacgataaaaacatcgttcagatgcccgacgggtatctgaataaaacccctctgttccagtttattttgttatcctgcctgttcccgttatggggatgcgctgctgcgttaaacgatatattaattacgcagtttaaaagcgtattttcattaagtaatttcgcctctgccttagtgcagagcgcgttttacggcgggtattttttaattgctattccggcttcgctggtcattaagaaaagcagttataagatggcgattttaatcggcctgacgctctatattgtcggctgtacgttatttttcccggcgtcgcacatggccacctacaccatgttcctcgctgcgatcttcgctatcgccatcggcttaagtttccttgaaaccgccgccaatacctacagctcaatgctcgggccaaaatcccacgctaccctgcgccttaacgtcagccagacgttctatccggttggcgcgatagcgggcattctgctcggcaaatatctggtgttttccgaaggcgacagcctggaaaaacagatggcgggcatgaacgccgcgcagatgcatgactttaaagtgctgatgctggaaaacactctcgaaccctataagtacatgatcatggtgctagtggtggtcatggtgctgtttatgctgacgcgcttcccgacctgcaaagtggcgcagaccacgaaacgccagcgcccgtcggcaatggacacgctgcgctatctggcgggtaacgcccgcttccgtcgcggcattatcgcgcagttcctttatgtcggtatgcaggtcgcggtgtggtcgttcactatccgtctggcgctggagttaggtgacatcaacgagcgcgatgcctctaactttatggtctacagcttcatctgcttctttatcggtaaatttgtcgccaacctcctgatgacccgcttcaacccggaaaaagtgctgatcctctattcggtgattggcgcgcttttcctggcctatgtggcgctcgcgccaaactttaccgcggtctacgtggcggtcgcggtgagcattctgttcggaccatgctgggcgaccatctatgccgggacgctggacacggtcgataacgagcacacggaaatggcgggtgcggtgatcgtgatggcgattgtcggcgcggcagtggtcccggcggtgcagggctatgcggcggacctgttccattcgctgcaactctccttcgtggtttccatgctgtgctttgtctatgtcggcatctatttctggcgtgaatcgaaagtggttaataaggaggctcctcatggcaacgcgactgacactgtggcgtgagttatttaccgcgcagccgaaaatcctgctggaaaacagcgacttcagtgtcaccgcttttcgttacgccagcggcgtggaagggctgaaagtggcgaacacgcgcgggcatctggtgatcctgccgtggctggggcagatgatctgggacgcggaatttgacggtcatgacctgaccatgaaaaacatgttccgccagccgaaaccggccaaagagatcgtcgatacctacggctgtttcgctttccactccgggctgctggcaaacggctgcccgtcgccggaagataatcacccgctgcacggtgaaatggcctgcgcggcgatggacgacgcctggctggagctggacggcgaggcactgcgtatcggcgggcgctacgagtatgtgatgggcttcgggcatcactacgaggcgcagccgtcggtcacgctgcatagcgccagtgcgctgttcgacatccatatggcggtgactaatctggcgtcggtggcgatgccgttgcagtacatgtgccatatgaattacgcctatgtaccccaggcggcgttcagccagaacctgccggatgaggcgctggcgctgcgggagtctgttccggcgcacgtgaagcccacagaacagtggctggcgtttaacgaacgcatcagacagggtgaggccacgctgacaacgttaagcgagccgcagttttacgatccggaaatcgtcttctttgccgataaactcgatcgctacaccgcggcgccggaattcaggatgaccgggccggatggcaccacctttgtcacccgcttttccagcgccgagttcaattatgtcacgcgctggatcttatataacggcgatcagcaggtggcggcctttgccctgccggcgacctgtcgtccggaaggatttctggcggcagagcgtaacggtagcctgctgatgctggcgccgcaggaaacccggcgtttcacggtcaccaccggcattacggcataaactgaggctgtacgtcgccgcgtttacccttatgataagcgctcgcaaaaggtgctggagctttcatgatttggttaacgctggcgacgctggtcgtcgtgtttgtcgtgggatttagggtattaacatcagattcccgtcgggcggtgcgccgtctgaatgaacggctcggcatcacgccggtgccggtggagtcgatgctggatcagatgggaaaagccgcagctgcggagtacattcagtatctggcgcgcccggatgaagcacatctgcaaaatgccgcgcaggtgctgctggtgtggcaggcatgtattgtcgatgccagcgagcaaaaccttcagtactggtaccgtctgctgaaaaaagcccgccttgccgccccgctgaccgatgctcaggtgcgtcaggcgctcggctttctgcgcgagctggagccggacgtggcggaaatcaataatttccaggtacgctataacgcgctctttatgccggacgacggcgtgcactggctgcactgatttttcccctctcccctggggcgagggaaaaccctgaatccgcactaaagttgctaaaacgttaaatacgtcacactcacaatgttacactgcgcaactttctcgccaataccgacgcaggggacgacatgagtgagcataaagaaggacagcagcgaccaaactggtcggcagtgtttgccgtcgcgttttgcgtggcctgcttaattacggtggaatttctgccggtcagcctgttaacgccgatggcgcaggacttaggcatttctgaaggcgtggccgggcagtccgtcacggtgacggcatttgtcgccatgtttgccagcctgtttattacccagactattcgcactatcgatcggcgctacgtggtgattttattctccgtgctgctgacgctctcgtgcctgctggtctcctttgccaacaacttcacgctgatgctgctgggtcgcgcctgtctgggcgtcgcgcttggcggcttctgggcgatgtccgcttcgctgaccatgcgactggtgccggcgcgcaccgtgccgaaagcgttgtcggtgatcttcggcgcggtgtccattgcgctggtgatcgcagccccgctgggcagcttcctcggcggcattattggctggcgtaacgtgtttaatgccgccgctgtgatgggcgtcatctgcacaatctgggtctggaaagcgctgccgtcgctgccgggcgaaccgatgcagcacaaacaggatatgttcggcattctgaaacgtcccggcgtgttcgcagggatgtgcgccattttcatggcttttgccgggcagttcgccttctttacctacatccgtccggtatatatgagcatggccggtttcgacgtggacggcctgacgctggtgctgctgagcttcggtatcgccagttttgtcggcacgtctatgtcatcgctgttcctgaaaagatcgctgaagctggcgctgacctgcgcgccgctgttgctggcggtcagtgcgctggtgctgatgctgtggggcagtaataagatcgtggccgccgctattgcgatggtgtggggcttaggttttgcgctggtgccggtgggctggtcgacgtggatcacccgttcgctttccgatcaggcagaaaaagccggatcacttcaggtggcggtgatccagcttgccaatacctgtggcgccgctgttggcggttatgccctcgataacctcggcctgctctcgccgctggttatctccggcagcctgatgctgttaacagcgctactggtggccgcgaaggttcgcgtaaaagaggtgcattgagggttaacggtcattatgcccggtggtggcttgcgccttacccggcttttacatctgtaggcccggcaagcctgcgccgccgggcaacccatactagaaccacgcttcccacatcgcgccgacgttgaacgaatccagggtttcatcatcggtattgttgatacgcgcggtgcgttcgttatccaccttgccgccggtcacgtagaagcgcagcatcggacggaattccggtcccatgtcgatggagatgttctgcgacagcgtggctttccagccgtggttatccccgccctggtcgaaatcaactttctgccagcccagttccagccaggtggaatgcacctggttccaccagtacatcggacgcacaatggcgttgtagttgcgacgatcgtcgatgttgttcgcatcgttcgaatagtcgtggtacgccagcaggtattcgacctgcgcctgttgggtaaacttgtagttaccttcaaagctggcgtagatcgccgtcagctcgtcggttttgttgtagacgctgttgtctgagttatcggagtagcgggcgatgactttattcacgccgctgtcgccggtgtggctcagcaccacgccgccctgccaggctttcagacgctcatcgctgtcgacggctttcgagtcaaagccatagttggcgtacagctccacgtcgatcggaccggctttgatgccgtgaactttcgaggtcaccgcatagttgcctttatcgccggtgccggagccgccggtacaggtgatacgcgacgggttgccttcgtcattcatcacttccgggctacaggattccacggctgccacggtcgccacgtcaaactgcacgccgccgatgtcgaagtttttgatccccgcgccctggccgtcatggttcatccagaagtagtcgttgatgccctgttgcggacgctgatggaagtcacgacccgcccagatataggcgttcgggttggactccagaatgttggtcaccccggcataggcttttttcaggttcacctcgtcgccccagtgatcgatcatcacattgatgtcccagatggcgccgttcgagcctttaaaggctttggaaagctggaattcgccgccgttgccttcgttacccaggcgaccaatcgccgaggagccgttataggagccatcgacgccgacaaatttctgatcgccgctctggaactgcgcgccgtaacgcgcatagccggtgaacttcacaccgaacgggatcgccatgtccggcgtctgggcggtgctttgcggttcggtgatgacgtcggctttcttcgcaatggccgcgtccattttcgcctggcgctccgccagggctttatccaccgctttagccacgatggcgtcgatctgttcctgagtaaattcctgtgccactacgtttcctgagcaaagcgcagccatgaccgccagcgccaccggaagttttttatttaatttcatgtttgtctcaatgtagtaaattattttcagacaataatcatcccgtccgtattaaacggaataattgtgctatcaccatgtcatattatttgtgggtacagatgtattaaaatattctcgtaacgatttctccgttatctgataaataaattaacgttgatacagctggacgatttcttcggataattcacgggccagtaatgacgtcattaaatgatcctgggcatgaaccataattaatgtcatcggctggcgggcttcgcctgcatcctgctcaatcagtttggtctgcatatggtgcgcctggcgcgaatagccgtcggcttcgcgcagcaggcttttggcttcgtcgatgttgcccgcgcgcgccgcgcgcagggcttcaaagcacaggctgcgggactgcccggcattgacgataatttccattaccgcttcttctaattcgatcatgataaagactcttcgttaaaaccattgttggctgaggtggcggcaaaccattccccgctttttttgacggtgcgcgtctgggttttcagatccagctggacaaaaccgtagcggtttttatagccgttacaccaggaccagttatcaataaaggtccacatgtgataaccaaggcaattacagccttcgctgatccctttatgcagccacttcaaatgcccggatacaaattcaatgcgataatcgtcattaattttaccgtcttctacaaagcgctgttcattttccacgcccatgccgttttcagaaataaagcagcgcgggttgccataattgacgcgtaaattggtgagaatgtcgtaaatacccggctcgtaaatttcccagccgcgatacggattcattttccgccctggcatctcgtaataatcaaacaaccactccggcataaacggtgactgcgggttaacggcgttttcacggcatttcacccgacgcggctggtaatagttaatgcccagcaggtcgatttttccttcggcgatcagcgcgccatcttccggcgtgcaggcgggcagctgatcgtactctttcagcagcgacaccagatcgggcggatattcgcctttcagcaccgggtcgaggaagctgcggttaaacagcagatccgcatggtgcgcggcggtgacatccgccggatgctgcgaacgcgggtacgacggcgtcaggttcagcacgatgccaatctccccggcgtagtgcccggcgcggaatgcgcgcaccgccgaggcatgggccagcacagtgtgataggccacggtggctgcgcgtttgaaatccaccacgttcgggtaatggaagtcatacagatagccgccttccaccggcacaatcggctcgttgaaggtaaaccagtgcatcacgcgatcgccgaacagctcaaagcagacctgcgcgtaacggctgaacgcctccaccacctcgcggttttcccagccgcctttctcctgcatcaccatcggcatatcgaagtggaacagggtgataaagggcgcaatgccctgcgccagcagctcgtcgatgacgttgttgtaaaacgccaccgcctgcggattcacctcgccggttccgtccgggatcagccgtgaccagctgatcgaggtgcggaaactgttgtgattcagctgtttcatcagcgcgatatcttcgcgccagtgctggtaaaacgtcgaggtatccgcagggcctacctgctgatgaaagcgccacggctggctggcgtaccagtgatcccatgtcgttgcgcttttaccgccgtgctggctttccccttcggtttgcagcgccgaactcgcgctgccccaccagaaatgcgcgggaaatgcgtatttcatctcaaccttctccttattcattacgggctgaccgtttccgccagcggactggtggcctgcgctttctgctcttcggttttcatcagcgagcgctcataggcacgcaggaacggcaggtacatcagcgccgacagcaccatacagatgaggcacatcaccaccggactcagcgcccagttggcggcccaggacgcgcctatcggtgccggtgtggtccacggcgtcagggagaccacctgtgccagccagccgagacgggtcgcgccatacgcgaggcaggcgttaaccatcggcacgaagacgaacgggatgaacagcatcgggttcatgatgattggcgcgccgaacaggatcggttcgttgatattaaagaagcttggcacgatgcccattttgccgatggtccgcaggtgcgtcgcacggctgcgcagcagcaggaacgccagcggtaaagtggagcccacgccgccaatcagcagatagtgatcccagaagccctgcagatacacgtgcggcagtgcagcgcccgcggccagcgcggcctggttggcagaaaggttcgccatccagaacgggttcatgatgccagtgacaatcagcgaaccgtggataccggcgaaccagaagatctggcacagcagcaccgacagcagaatggcgggcagagaatccgatgcggacaccagcggctccagcaggtgcataatcgcctgcggcaggatcatgccggtctgcgcttcaatgaacaggttcagcggatgcagggtggcgatcaccaccagtaccggaatgaggatctcaaacgagcgcgccacaccggtcggcacttctttcggcagacggatggtaatgttgttctgcttcagccacgcatacatgcgggtggaataaattgcggtgatcagcgcggtaaaaatcccctggccggacaggtactgcgtggagattttgccgtccgcataaggtgctgcgaccagcaaaaacgccataaaggccagcagaccggacatcaccggatcgagattaaactgccgcccgaggctggcgccgatgccgacggagataaaaaacgtcatcacgcccatgctcaggttaaacggcagcatcagctgttcgcggtaagtctgggaaaaatccagccagccacgggcaaagctgttggtggtatcggcggagaacggcgggaagataaacaccagcataaacgaaccgatgatcatgaacggcagcgcggcggtaaagccatcacggatagcgataacgtatttctgctgccccagtttgcccgccagcggggtgatggattgttcaatgacggcaaccattgactgatataacgaactcataggaacacctttttagtgcgccgcctcgatgagcgacagagcatagtccagtaccttatcaccgcgctgcataccgtaatccatcgggttgatgggctgaacgggtatgccgcaggtggcagccttttcggaaagcgtatttaacatatattttacttgtgggccgagtaacaccacctgatagcgcgagaactgcgtatcaaattccgccacgccgtaggcatcaatctccaccggcaaaccccgggtttgcgcctcttcgaccatttttctgaccagcagacttgtggacatgcccgcagaacaacacagcatgatcttgaccatcgacaaccatcctcaaaatgttaaaagttattgcggagctgattggataacaaacggaaaccggtttccattttttcgcggatgaattgtgaagcccgtcaatctctgtaatttataagcgttctttattagcgctgcatcacagattttgcggctattctgatagcaggaaagtgcgtttggaaaatcggtttccatgaaaaatggaaagcggttatactgcaactggcgatattatgagccattgtacgatttggaattttttggccctcgccgggcctcccaggggataaagatgtctacaatcaacgacgtatcacgtttagctggggtgtcaaaagccacagtttcacgggtgttgagtgggtcgcgaggggtcaaggaagccagccgccttgcggtgttaaaagcggttgatgaactgaattatcggccaaacgtcatcgcccagtctctgctgagccagtccacgggctgtatcggcgtgatttgcgcccaggataacgttaatcaaaccaccggttacctgtacgcccttgagaaacatctcagccagcatcagaaacatctgctgctgcgttttgccaacaacaaagcgggcgtgatgaacgcgctggaggagctgacctgcggcttgtgcgatgacgtgctgatcattggcgcacgttttccgctgggcaacatcgatgagagcgtgatcctcgtggattgcgccgaggcggaatccaccaacagcatccagtttgaccacgctttcgccgcagaaaccgcctgtaattacctgataagccagggccgacgccagatcgccgtcatccacccggataccagcggcgcggcggatcaggttttactgggttacaaacacgcgctggaaaacaatttcctgccgtttaatcgtaatctggtgtttatggattccaccagttcgtccgtcgccttacaggtcctgcttaacaacgcgaccacgctgaactttaacgcgctgctggtggccgacgagcaggaagcgcagcgggtgatcagtcagcttcaggcgtttaataaatcggtgccgggcgacattatggtattcagccttgccggttcgctgcaattaccgggcattccgagcattcccgctatcgagtattcgatggacgccatggccgcccgtattgtcagctggcttaccgaaaaaacgcaaagcgtactgggtgcctgcgtactgcgcggcgatttaattatcccggatcgcagaacgcgttaattactcatcgcctccgcaccctgcgggggcttttttgatagcgatcaccaaacgaaaatatatccttcctccgcttgccattacttaagaaatttaatttaaggcccgcaattttagattgcggttttgaatgaatgcgcaacacaatacgcgtcggtatctgtaagattacgtcatgctatgagcgatcatagtattggcggtagcgttccctggcacagccgatggcatacgaattggctcatagcgatagatatgtatcacgcatatttaataaataaaatttttaataatattgttgaacgtgaaaaaatgtttttttatttcctgagtacgggaggcagagtagagcctggcgtatattgaccattatgtcttttaaatctctgaaaaaacgccgcaatatcaggacacgctgaacagatccggcacaggcagtgattttcagcgggggatccaggcggcgacagcagatgccgtgtccggtgaactgcagcaaaagtgattgccgcacggttgtatccgcatgcgaaagagatgtctgatctgaacgaagaggaaaaacagacggtcagcatgctggcgacgatgtcggcaggcctggcgggtggccttgccggtgacagtaccgtatcggcaggtacaggtgcacaggcagggaagaatgcggttgagaataatttactgggaggtaatgaagatgctcaagctgcatggatacgtgagcatgggatcgatatggcgacctgttctgataacccaacggtgcaagcatgccagaaggctaaaaatgaacgagatgcggtaggattggctttggcaacaggtactgtggctttgcttcctggtagtgctcaggtgatgtggggacttggtgctggcgctaatgcaggggttaattactgggtagatggcgcaattgacccagctaatgcggctattgcaggttgggtgaatgtgttcagcatgggtaatggcctaacgggtagcatgggctggaatgcggcaggtggtacgttgggtaactggattgacagcaaagatccgctgttaggtgcgcttattaatggtgccggttcgggtgttggttatggcattggtaaaggactttcatggggcgttaatgccggagcaaactggtggaaaggttgctgggatcctaagtttaatgctgacctgagacagtttactgaagtgaaggggaaactggggctttcaaaagaaatgacacctagtaattttccaggcatggctggcgatatcggtggtagcctgggctctgagctcagtgggaagtatatagagcagaaatcatctcaggaggagcgcaaaaaatgagaaagaaaaatacgtttctacacctggctctttttatcgcattaagtattatttctatttttttgacatcgattactttatacgtagtaggggagttattattcttctttttcagagaaataccaatgaatttcactatggaaaatatatttctgctctgtaaaattagtcttagcgtcggaagttttgtcgggggcggattgtggatagctcggttattgaaattaaaaggcttctaagtttttgctgagaataatttattgggtgggaatgaggagacccagaccagcttcgtgcaggaacatggaaaaaatatagcgtcctgttcaagcaatcctggcagtgttgcctgccagaaagggctggcgatgaataatgcgttgatggtggcacttcctgcgggtcttggtggtggcatccaggcggcgacagcggggctacaggggctggcgggtggcaatatcgcgggtgcgctggcgggcgcatcggctcctgagctggcgcatattatcggacatgaatccgggctgagcagcgatgccgcccttgtagcgcatgcgatcctcggtggtgtggcggctacgttgcagggaaacagtgcagcggcaggcgcagcgggtgccgtgtccggtgagctggcagcaaaagcgattgccgcacggttgtatccgcatgcgaaagagatgtctgacctgaccgaagaggaaaaacagacggtcagcatgctggcgacgatgtcagcaggcctggcgggtggccttgccggtgacagtagggtatcggcaggcacaggtgcgctggcagggaagaatgcggttgagaataatacatttagtttgccaaacgggataatgaactacggccaggcagtagcttcctggaatcagttcgcggtaaacaataacctgacacaggaagaaacccaggccggggtggataagatcgcaaaaggcgatatgccagacagcaccaatatcgctaaagtaatggtggatggctcctcgaatatggcttttgcttttgcagcatgggaactggggctagcggcctcagttggtaaagccgtggttggtggggttacttccactgctgtgaacggtggttttcaatggtatggcttaaaccagcctggtagtgaagatcagtcatgggattataaaggcagtgcatcctcattcattacagggatgcttgctccgggacgcaaagttacgattaatacagctatagcgctggggggatcggtatttagcgatggtgctaatattaagtctcaagccggaacagccctgggggcatatgcaggtggatatgtaggagaatacttccctgtgatattgaggccggttttagggagctctgcaactgctgtcggtgatattagcggtggttttgtttctgagttaattaactacggtattaaaaataatcccactccaactagtaaggaaccggaacatgagtaaaaaaccttcagtatttttattatttttaacaataatatattgttgggtgatcttttttttaatcggtagcgtagtgctgctcattatgaatttatggaaagggaatggcttctatttttcacaacaacaagttaaagccgccatcatattgagtgggatagcagggtgcggcgttggattaagaacatggatctttgcattgattgataaacgtaaatcccgaaagtcaccatcatgagaccctaaagcgtaaattcaatcccgaccacagttggtggtatttttgcccggaaatatttttcgatagctattgaatctgcattgcaaatttaataaataagctgaatgagtcaggcgcgaataatataaattccaaagaataacggcagaaggttttcctcctgccgcagaaataacgaaccgggttttacactcaaataaacgtaaaaatctcgtcacgcggcaggcgggattttggcaggctggcgttaaaatctttgtcgcttttcacgcccagcgacaccagtaccacgctggttaagcctttttcacgcagccccagcgacagatccagctcgcgggaatcgaaaccttccatcggcgtggcgtcgatgccgagcatcgcggcacccagcagcagaccgcccagcgcaaggtacacctgcttttccatccactgcggcacatcgcgcagttcatagcgatgcatatccacgtagccacggcggcccttatcctgcccggctttggcttcttcgctggcgaagcggccatctttctgctcctgttccaacacgttttgcagatgttcttccgtcagatcgcttttcatgcacagggcgattacgtgggaagcattcagcacttttgcttcgttataggaaaatgcaccgccagtggatttggcgatcgcggcgcggccttcggcggtggaggccaccacaaaatgccacggctgggagttcaccgacgacgggctgttttgcagcacgttcagcagggtttcaatatcgttttccggcaaagtctggccgggttcaaaagctttgacggtgtggcgggaaagcacggcatcattaagcgtcatcattttttcctttccaaaaagtgaaacgtaacggttgttcgcctgagaataacgccaaatccgacgcagaaaaacctgtccggcggtgcagcactttctctttaaagatgaaaatcaggtgcgcgctggcgcgtttctggcaacaatgaaggccgtttttttcctgttccggagagcgtcatgatccgcctcgaagatgtgaccttgtttgtgcgcgccgcggcgttaggcagtttttctaatgccgcccgtgaggcggatttattgccggggcaggtaagcgccgccgtgcaccggctggagcgcgatctggataagcggctgtttgtgcgctccacgcgcagcctgcggctgacggcggaaggggaaaaatacctgccgttcgcccaggagatgctggcggtggtgcaggcggggcaggagagtctgcacagcagcgatgatgaactccagggagagctgaaagtcgctgtgccgtcggatattggccgcaatgtgctgctgccgctgatcaccgatttttgcgcgcagcatccgaaaatcaccctgcggctgtcgctgtccgatcagatcagcgatatttttcgcgatccggtggatgtggcgatccgctacggtgtgctggataacagcagttatgtcgccctgccgctggcggagaaaaaccgccgtgtgctggtggcatcccccgactatctggccgcgcacgggcgtccggcgacgctgggcgatgtgacccatcatcattgcctgctgtacaccatgaacagccacgtccacgataaatggacgttccatgaaaacggcatgcgccgccagcttacggtgaaaagccggatgctgtgcgatgacgctgacgtcgcccgccgctgggcgattgccggaatgggcatcgtctacaaatcctggatagacgtcagcgccgatgtcgccgccggcaggctggaagtgctgttgccgcacattgccggcgaggcggcaccgcttaaccttatctgcccgcaccgtaagcaattttccccggcgatccgccagctgcacggcatgttgcgcgcgcagatgacggcgatcacagaccgactggccgccccgcgttaacgctgttgcagcgggcggcagatcgccagcatggcgatggcgctgcaaagcggcacggcggcgagcagcagccagggcataatcgcctgcggggagggcgtcagcgcgtggtcgagctgcccgccgagcagaaaattacccgccagcaccgccacgccgcccatcgaggcaagcgcgccgtaatgcgcgccgaggttatgttctccggcgaaacgcggcaccaaatccatgcccaccggcacaatgatcatctgcccgagcgttaacagcgtcaccatgcaaatggcggggatcagccgctgccagttatcgggcggcacgtcagcggcaaaaaacgccacgctggcaaacgacgcgctcaacagcccgaagccgagcggcagcgtgcgcaacgggccaaggcgacgggcaaaacgcgccagcggcagttgcaggcagacgatgagtagcgaggcgagcataaacagcggcccgagatcggtttcccggctgccggagcggcgcagttccaccggcagcgccagatagagctggttatagctgaacagataggcgctgtaggcgatgataaaagccacaaaacgcggctggcggaaggtctcccaccagggggtgatcttcagttcactggccctgcgcggcgtggcgggcaggctgaaaaacagcaccaccagcgcaacgataaacacccccgcaccggccagcgccacgcgctgaaaaccaaatcccgccagcagcgcgccgagcaccggccccagcaccgcgcccagttccccgcagatggcaaaaagcgcgaaccactcctggcggctgcgcttgccgtcggcttcgctctgcgtcccggccttcgccagcagcgcctcgatggcaggggaaaacagcgccccgccgacgcccgtcagacaggcgcccagcaccaccggccagaacgactcccccagcgccagcagcagatagccgctcacccgcaccagacagccgctgaggatcaccacccgcgcgccgaagcggtccgccagcgcgccgcccaccagaaacattccctgttgcgagaaagtgcgcaagccaatcaccagcccgatcacccatccggacagcagcaggtcgtcgcgcaggtaaatcgccagaaaaggcacaacggcatagaagccaatattaaagaccaactggcagccggaaagcagataaggggaggtgcgttttgttgcgtctgtcgaagtcgaaaacatgccataaccgaagttgagtgatgaaaattgacaatatattttgcgatgggtataagtccaccacttaagaatgatttgcatttacctgcgcgtagccactgatcctctggagtaagacgaatgccggttttaaagaaaacgctgttagctttaggaatactttgcctgagtacggcatccgccctggcgacgcactatccgttaaccatcgataactgtggcatgaaagtcaccttcgacaaagcgccggagcgcgtggtggcgctggggcagaactccgcagaaatcatgctgatgctcggtttgcaggacaaaatggccgccagcgctttctggccgacaaaagtcttaccggaactcgcgaagcagaatgaaaaagtcaaagtgctgaccgtggagatcccgacgctggagtccattctggcacaggagccggattttgtggcggcgcaattgccgttgctgctcgggccggacagtaaagtcgctaaacgcgaagattttgccgccgtgggcgtaaacagctatttatcgccgggcgtctgcaccaccaccaaaaacaccggcgacatctacggcagccgcaagcagatgtgggacatgacccagctgtacaaagaaattaacgacctggcggcgattttcgacgtgcaggatcgcggtgatgcgctggtggcgagcttcaaaaagcgtgaagccgatctgcgcgagaaattccataagggcaataaagatctgtcgttcgtcttctggttctccagcgcctcgccgtcagccgatgcgcacatgagcggcaaaaacagcgcctccggctttatcgcgaatatgctgggcggccacatcgccctgaataccgacgccgaatggccgacggtgagctgggaaagcgtgatcagcgccaacccggacgtgattgtcgtcgccagcctcgaccgtaaccgctgggtgctggatcgcgcggaagaaaaaattaaattcctgaaaaccgatccggcggtcagccagctggatgcggtgaaaaaaggccatatcgtggtgatggatggtcaggcgatgaacccgaccgtgcgcaccctctatggcgcggagcaggtggcggcacaattagagaagctgggtctgaactgatgactgtggcgtcccgctcggtagttgaaaatatgcgatccgtgatgttgctgctgggcgcggtgctggtgctcggcatcaccatcgccttcagcgtcggggtgggcgagctgtcgatcccgttaaaaaccacgtttttcgccatcaccaataagctcggtctgaccggcgtaaccttaaaccgcatccatgagacggtgatctgggattttcgtctcagccgggcgctggttgccgcctgtagcggcgcggggctggccatctgcggcgcggtgctgcaaagcctgctgaaaaacgcgctggcggagccgtatgtgctgggcgtgtcagccggtgcctccaccggggcagtagccgtagtggtactgggcgtgggcgccggggcggtgtcgctctccgccggggcatttatcggcgctttcgctgcgttcctgttcgtcgcgctgctgaccaacggcgcgcgtggcggcaatgaacgtaccattcttgcgggtgtggcggcgtcgcagctattcaacgccctgaccgcctacaccatcagcacctctgccaatgcgcagcaggcgcgcgatgtgatgttctggctgctcggcagcttcagcggcgtgcgctggccggagttccagctggtgctggtggtggtgctgattggccttgcggtgtgtctgtaccacgcgaaagcgctggacgcctttaccttcggggatgacgcggcggcatcgctcggtattcccgtcggtgtgatccgcttgatcctgttctccgtcacggcgctgatgaccgccgcgatcgtcagcatggccggttccatcggttttgtcggcctggtggtgccccatatgatgcgctacttctttggcccgctgcaccgcaaactgctggtggcgtccgcgctgatgggcgcgattttgatggtgctggcagatatcgcctcccgcacggtgatcgccccgcaaagcctgccggtgggcgtggtgacggcgctggttggcgtgccgttctttgccgttattctttatcgctcggggaaattttcatgagtatcagtgccgaaaatctgtcctggcgtatcggaaaaaaagtcattgttaatgatgtgtcgctcagcgtgcccaaaggccagaccatggggctgctggggccgaacggctccgggaaatcctctttgttgcgtattctggcgggactgcgtcggcccgacgcgggccgggtgatgctggacggcggcgatgtgcgcgaggtcggcaaaaaagcgctggcgaagcgcgtggcctttgtggagcaacatgcggcgacggattccaacatcaaggtgatcgatgtggtgaagctggggcgcattccgcaccattcaccgctgtcgccgtggacgcatgcggatgacgagattgtcaccgccgcgctggcgcgcgtggagatgctcgaccgccagcagcagggctggcagagcttgtccggcggcgagcgtcagcgggtacacattgcccgtgcgctggcgcagtcaccctccgagatcctgctcgacgagccgacaaaccatctggatattcaccatcagatgcagctgatgcggctgatcagcgcgctgccggtcaccagtattgtggcgatccacgatctgaatcatgcggcgatgttctgcgattcgctggtggtgatgcagaacggcggcatagtggcacgcggtacgccggacgaggtgctgaccgaagagatgctgcgcgaggtgttcaacgttgaagccagaatcgaaatttcccgctacaacggcaaaaagcatattcactttttgtagggggatgcggtgcagcgccgggagccgggctgcgccgcctgtatccggcacgaagtgacattaattgagcgctgccagcgtcgattcgatcctttttatcctctgctgcgccgctttcagttcatcctggagccgctgctcctgctcattgtaagccatcagcacaatgcatccgttcatcacttttaccgttacctggtgtccggtatcgaaccccgcttcacgtagccatttccctttcaggatcaggttcggcgtgcttttatcccggccatgcgggcgatagcccacgatcacggaacgctcgctttttctaatctctgactctggggtagaatgcggatcagccataatcaactccttgatagttggtgaggttagacgctccggctgtgttgctgcacatcggagcgttgtttaattcctgcgtgtatgtggtaggtaccacatgcgtataaactaaccgaaatggtacctaccatgcaagaaaaaaagaaaccaacctttgaccgcaccaaaagcaccatgaagaacattcgttttgaagatgagcttctggaacagattgagaaagcggcgggaaaagggaattttagtaagtgggtgaaagatgcctgcaagatgcgattgcagaaaaactaatccgccagctatgcaggaaggctgcagtgaagcctattgacctacctgacggctgccttcctgttgaacttgtaagtaagacttacaggttgcattttgttcaagttcgccttcttcgtagatccctttgatgtgctgcgtaacggcctgcggggtaatctgataaagatttgcgatagttgcctgagggagccatagcgtctcctgttcaaagcgacattccacgcgcacttcgccgtcatcactggcaaacataataaactcgcctgccggagcctggcctgaaagttcctctgtcatgctgcctccttaaacgctggacgaaaattatctgggaatctatcagaatgttaagcattcacgacgttaccatgaatgccataaacacggttatcaacatagtatgtgaaaacaaacaggagtaaaaaaacagaaatgaaacgtgggggtagttcgcaaaatttgcgttaagttggagaacattgcagaggatttacgccacaagtggcggaagatcacaggagtcgaacctgcccggcaccgctggcggcaccaactggatttgaagtccagccgcctcaccggagacgacgatcttcccagccttcattgctacatggaggcggggcgcattatagccactttcctgctgtaaccacataccccgtcacacttttttatcagatctgcgtcaaaccttcgtctggttttggttaaaaccctattaaatccattgcttatcctcccgcctcattttcagctaccccgatcacataaaacaagaatcgtaatctgataaccagaaaacggaatacccgcttccggaacgatggtttaaaacgtctgcacctggtatcggcgtacttctgagcaaaaggatgaaagatgaagagtcagattatttctgtgaaggagaagattggctacggcatgggtgacgccgccagccatatcatctttgataacgtgatgatgtacatgatgtttttctatacggatattttcggcatccccgccgggtttgtcggcaccatgttcttactggcccgggcgctggatgcgatttccgacccctgcatggggcttatcgccgaccgtacgcgcagccgctggggtaaattccgcccgtggatgatgtttggcgcgctgcccttcggcatcgtctgcgtactcacctacagcacgcccgatctgagcatgaacggcaaaatgatttacgccgccgtcacctacacgctgctgaccctgctctacaccgtggtgaatatcccgtactgcgcgctgggcggcgtgatcaccaacgacccggcgcagcgtatctccctgcaatcctggcgcttcgtgctggcgacggcgggcggcatgctctccaccgtgctgatgatgccgctggtgaatctgattggcggggaagacaaagcgctgggttatcagggcggcgtcgccgtgctgtcggtagtggcgttcctgatgctgacgttctgcttctttaccaccaaagagcgtatccaggtgccgccgaacaccacgccgatgcgtgaagatctgcgcgacatctggaacaacgaccagtggcgtatcgtcggcctgctgaccatcctcaacatcctggcggtatgcgttcgcggcggggcgatgatgtactacgtcacctggatactcggcacgccggaagtgttcgtcgccttcctcaccacttactgcgtcggcaacctgatcggcagcgcgctggcgaagccgcttaccgactggaaatgcaaggtcagcatcttctggtggaccaacgccctgctgacgattttcagcgtggcgatgttctttgttccggtcagcgccagcctcaccatgttcgcttttatctttatcatcggcgtgctgcatcagctggtgacgccgatccagtgggtgatgatgtccgataccgtcgattacggcgaatggtgtaacggcaaacgcctgaccggtatcagcttcgcgggcacgctctttgtgctgaaactgggtctggcgattggcggcgcgctcatcggctgggcgctggcgggcggcggttatgacgcggcggccaaaacccagaacagcgccaccatcaccattattatcgcgctgttcactctcgtcccggcggcctgctatttcctcagcgcgatcatcgcgaaacgctactacaccctgaaaacgccgttcctggtgaaaatcatggaccagctggcgcagggcgtgcgtcgcaacgaacaggcgtttaacgagacacctgtcgccaaagaattaccgcattaaaaggagccgataatgaaaatcagtgatggaaactggcttattcagcacgggctgaacctcattcacccaatccaggtgttcgatgttgaacagcagggcaatgagatggtggtgtacgccgcaccgcgcgatgtgcgtgaacggacctggcagctcgacacaccgctgtttacgctgcgctttttctcgccgcaggaaggcgtggtcggcgtgcgcatggaacattttcagggtgcgctgaacaacggcccgcattacccgctgaatgtgcaggacgtaccggttgagatgcagaacacggcggagttcgccgaactgaaaagcggcgcgttaagtgtgcgtgttaccaaaggcgatgcctggtcgctggattttctgcgcaacggcgtgcgcatcaccggcagccaggtgaaaaacaatggctacgtgcaggacactgccagcaaccgcaattatctgtttgagcggctggatctgggcgtcggcgaaaccgtgtatggcctcggcgagcgctttaccgcgctggtgcgcaacgggcagacggtggagacctggaaccgcgacggcggcaccagcaccgaacaggcgtataaaaatattccgttctacctcactaatcgcgggtacggcgtgctggtgaatcatccccagtgcgtgtcctttgaaatcggctcggaaaaagtctccaaagtgcagttcagcgttgagtctgagcatctggaatattttgtcatcgacgggccgacgccaaaagaggtgctcaaccgctatacacagctgaccggccgcccggcgctgccgccggcgtggtccttcggactgtggctcaccacctcgttcaccaccaattacgacgaagccacggtgaacagctttatcgacggcatggcagagcgcgatctgccgctgcacgtattccattttgactgcttctggatgaaagccttccagtggtgcgacttccagtgggatccggtgaccttcccggatccggagggcatgatcaaacgcctgaaggcgaaagggctgaaaatctgcgtctggatcaacccctacattggccagaaatcaccggtatttaacgagctgaaagagaagggctatctgctgaaacgcccggacggctcgctgtggcagtgggataaatggcagccggggctggctatctatgattttacgaatccggaagcctgccggtggtatgcagagcagctgaaagggctggtggctatcggcgtcgactgcttcaagaccgatttcggcgagcgcattccgacggacgtggcctggcatgacggctcctgcccgcagaagatgcataaccattacgcctatatctacaacgaactggtgtggaatgtgctgaaagagacggtgggcgaggaagaagccgtgctgttcgcccgctcggcgtcggtgggggcgcagaaattcccggtgcactggggcggcgactgctacgccaactacgaatccatggcggaaagcctgcgcggcgggctgtcgattggcctgtccggctttgggttctggagccacgatattggcggcttcgaaaacaccgccccggcgcacgtctataagcgctggtgcgcgttcgggctgctctccagccacagccgtctgcatggcagcaaatcctatcgcgtgccctgggcgtatgatgaggagtcctgcgacgtggtgcgccacttcacgcagctgaaatgccgcctgatgccgtatctgtaccgccaggccgcgctggcccgtgacgcgggcacgccgatgatgcgcgccatgatgctggagttcccggacgatccggcgtgtgactatcttgatcgccagtatatgctcggcgatgcggtgatggtcgcgccggtcttctcggaagcgggcgacgtgcagttttatctgccggaaggccgctggacgcacctgtggcgcaacgatgagcttaccggcagccgctggcacaaacagcagcatgatttcctgagcctgccggtctacgtgcgggataacaccctgctggcgctgggaaataacgatcggaagccggactatgcgtggagcgacggcacggcgtttcagctgttcagcctggacgatggctgcgaagcccgctgcgaggtaccggcggaggatggcctggttgccttcacgctacaggcgcgacgggaaggggatcgcatcacgctcaccggcaccggtgatgcccgcaactggacgctgtgtttgcgcaatatcccgcaggtgagcgccgtgcagggcggctcacaggcgggcagtgagtggggggcagttatcaccgcgcaggagaatacgctggtggttacgctctgagtgttaaccctctcccgtcagggagagggtgtggtttccggctgcgcggtactcacctcgccgttgcgcatcgtctgtgtcacctgccgtttctctgtattcagcaccttcagttccgcattcaccgtgggttttaacggcgtatccgcttttacgttgccgctggcggttagctgaatattaccatcgccggaaatcggcagcgcaggccagccccactgctgcaatacgttcaccggcacgccgcgcccattgaggctcactttcacctggcgatcagccagctgcgacaccacagcggtggcttccagtaaaccctggccggtaaaggcgctcagctcgctgatgttgaccgcattggtgtttgcagccagcgccagcgacggacgacgcacatcgacgcggttaaaggtcgccgccgcgccgttcagtttggcgctaccgccccagacgccccatttaccgtcccgcgccagcagcaggttattaccataaccatccagcgcggtgatctgccacgggaaagccggatcgatgtcgatcaccaggttgcggctggcgctgaattttttcagcaccacggcgttcagccagccggggagaggatccatccacagctgtttccagttggcgggcagggtgtattccagaccggcgatggcggcgtcatccagcaccagcgctttgccgtcgcgcaaccagttgccggaggtgcgcagcaggccgccttcccagcgggaggtgaactggcgcagcgccacgccctggggggaaaactcagtattcacaataggatcgaacaggtgcagcgagccgtagataaactcgctggcgttcatcgacagcctgccgtcgtcgctctgccagtcgccctcgctcagcgtcaggttgcgcacgctcagatccagatcggttaccgcccagtccggcccctgcaggcgcgcgtctgtcacttccagcctgccaatctgcaacgatggcagcgtggtgagcggcataaagaaatcgctcagggatttgtcgctttgcaggcggatgtcattgagacgcaggctgtcgataatccagccgccgttggcggtacggcgggcggtaccggtgagcgagccgcgcgccatatccgcgccaatggtgctcagcgtcacctcattgttgtcgatactgccctgaatgaggacattactgatggggacgccattcagcgtcatggagcctgcgctcacctggatttgcgcctggctgccaagcacattgcccgctttcggctgccaggggctgacgccgcctgtcacccgctgggcactgagatcccagccagtcgccggactgttgaacgccatattgttcagttgcaggcggtcggcctggaagggcagcggcgcggtatccggagataaattcagcgtcccgtctgacagcaaaatagtatcggcatgcagcggatcggtgaactgacggctactcagcccaatatccaccgctttcgcatccagggtagcgggctggcccttgcggccaaacgtaacgctctttaacagcacatgggaaggcgaagaaaagcggtgatccactgcctcaacggtgagctggtaatcactgttatccgtaacccagtggcccacctgcgctgcgccccagcgcgtctggatcagaaaataggctgcaagaatcagcaccagcagcgcgatcagcagataaatcagcagctttccaatgagtttcatcgtcttcccttcctctatgcagacagggaatttatgcacgatttatgcgcaatgctcaaggagggaatggtgaaagcgtgtaacggcgacagcaggaaagccccgctgccgccgtgaaaatcagtttttctcaggcgggaaaacgaggttcagcacgatagcggtgataccgcccgcggcgatccccgaggagagcagattcttcagccagtccggcgcaaactgcaggatcagcggctgctgggaaacgcccagaccgaccgccaacgacagggcgataatcatgatcgcgcggcggttcagcggctcgcgggacacgatacgcaccccggaagcggcaatggtaccgaacatcaccagggtcgcgccgcccagcaccggctcaggaatgtgctgcacgaagccactcaccgccgggaacaggccgagcacgatcagcatcagcgccactacaaaaccgacataacggctggccacgccggtcagctggatcacgccgttgttctgtccgaaacaggagttcggaaaggtgttgaacaccgccgacacaaaggagttcaggccgttcgccagcacgccgcctttcaggcgcttcatgtacagcggcccggaaaccggctgttcggaaacgtcagaggtggcggtaatatcgccgatggtttccagcgaggtgatcataaataccagcatcagcggcagcagcaggctccagtcgatacctaaaccgtaatagagcggggtggggaccatgattagatcgctgctggtcggcgcggtgttctcaggcaacatacccagcgcccaggcgaggatataacccaccgccatagcgatcaccagcgaggccacgcgcagatacggattgcgctgacggttaagcaggatgatcaccgccagcaccgcacccgccagcagcaggtttttcggcgcgccgaaggtgtgatcggccatggcgccatagccgccgccgatagaggtcaggccgacctggatcagcgacagaccgataatcatcaccaccacgccggataccagcggcgtaataatgcggcgcgccaggtgcagcacgcgggaaaggaccatttcggtacagcttgccagcatcagggtgccaaacagcgccgccatcatggtcggcacatccgcgccgccggttttcagcgccgtgccgcccatgatcagcggggccacaaagttaaagctggtgccctgaatggataacagcccggagccaaccggtccccacgctttgatctgaataatggacgccacaccggaggcgaacagcgacatgctgatgatgtgctgcgtgtcctgagccggtaagccgagcgcctgacaaatcagcatcgccggggtgatgaccgcaacaaacattgccagcagatgctgacaggcggcaaaaagcgtttgtgccagcggcgggcgatcttccaggcggtagatcagctcactattatgctgcggcgcaaccggttgcgcattttcagactcgacggtgttaacggacatctctggcgatcccatgatggaaaagcggggattttatcggactgaatggtaaaagcaaacgtttgccagcaaaaaatctcataattaaaagggataaaaagcgaccgggatatagcgttatgcgtatgtcagagtgaatggctgaaaatttgcgtcaggcgttggaatagcgttcagtttccggcatccagcgctcgatcagcgcaagcgcctgttccggataacgctcatgaatatgacgggcgaggcgctgtacatcagggatcatcgcctggtcgcgcagcagatcggcgactttgaattcagcgttgccggtctgtcgggtaccgagcagttcgccggggccgcgaatttccagatccttttgcgcaatcacaaagccatcgttactgtcgcgcagcacctgcaggcgtttctgcgcggttttcgacagcggggatttgtacagcagtacgcagtgggacgccaccgcgccacgaccgacgcgaccccggagctggtggagttgcgcaaggcccagccgttccggattttcgatgatcatcaggctggcgttgggcacgtccacacctacctcgatgacggtggtggcgatcagcagatgcagctcgcccagcttaaacgcctgcatcaccgcctgtttttcggcgggcttcatgcggccatgaaccagaccgacgttaagctccggcagcgccagcttcagttcttcccaggtggcctcggctgcctgggcttccagtaaatcggattcttcgatcagcgtgcacacccagtaagcctggcggccttcgctcatgcacgcctggcgtacgcgatcgataatatcgctgcggcgcgtgtcgggaatggccaccgtggtgacgggcgtacgtcccggcggcatttcgtcgatcacagaggtatcgagatcggcatacgccgtcatcgccagcgtacgcggaataggggttgcggtcatgatcagctgatgaggatgaaagccctgttgctggcctttttcccacagcgccagccgctgatgcacgccaaagcgatgctgttcgtcgatgatcaccagcgccaggccgttaaactgcacctgttcctggaaaatggcgtgggtgccgacaatcatctgcacctgaccgctggcgatggcatcctgctgcgccacgcgcgctttgcccttctgtttacccgccagccagccgacttcaatgccgagaggggcaaaccaggcgcggaaattgttagcgtgctgctcggcaagcagttcggtgggggccatcatcgccacctgtttgccattggcgatggcgcgcagggcggcaagggccgccaccagcgttttaccggagccaacgtcgccctgcaccagacgcatcatcggaatatcaagcgccatatcgtgttcgatttcggacaccacccgtgcctgcgcgccggtcggtttaaacggcagtgacgccagcagctggtttttcagctcatcctgcgcggcaagcggctgggcgtggaaacgctgtgcgccggcgcgtaaggccagcatactgagattatgcgccagcagctcttcgaggatcagacggcgctgggcgggatgctgaccgctttccagatcggcaagttgtaaggtcggcggcgggcgatgcagcgtgcgcagcgcttccggcaggctcatcatgccctgggctaattcagcgggcagcagttcggcaatggcgcaggtgtccagcagttccagcgcctggtccgtcagcttgcgcagcgtcgcctgtttgatgccttcggttgtcggatagacgggggtcagggtgtccgccagcgccgggctggtcaggtcgccctgcacgcggtattccggatggatcatctccgcgccgtacttaccgcgctttgcttcaccgtaagccagcacgcgttttcccgtcgccagactgtttttcatcgccgcgctgaagttaaagaagcgcagggtcagaatgccgctgccgtcgctgatctgacaggtcatcatgcgacggccgccaaaggtgacgttacagttcagcacttcgccttccaccgtggcataaatgcccggcagcagatcggcgatggtgtaaagctgggtacgatcttcgtagcgtaaaggcagatgcaggagcagatcctgcacgttgacgaggccgattttggcgagcttgctgctctgcgccgcgcccacgccggtcagcgagcttagcggaatggcgtcaagcaggcggcctttcatgggttatttcgcagactgcatggtggcccaccacgcgtcatcggcttcgatttcgccctgcgcgttgacgtgggggtagggcaggcctttgcgttttgctacgcgggccagcaccggatagccgccttcaaacagcaaacgctgctgttcgtcttccggcagcatgctgttttcccgcttatacaggccggcgttctgccgctggcgctgggcttcatacagaatgagggcagaggcgacggagacgttaagcgactgcaccatgccgatcatgggaatgatgatgtcctgatccgccagatccagcgcttcctgcgtgatcccggttttctcctgacccatcagaatacaggtcgggcgggtgtaatcgatctcgcgaaaatcgacggctttatcagacagatgcgtcgccagaacctgcatgccctggcctttgagatgtgaaacggcgtcgctgatggtgcgatgggttttaacctgcacccagctgttgctgcccgccgcggaagaggccatggtgcgcatacggctgcccggccagacggcgtgcacttcatgcacgccaacggcatctgcggtgcggataatagcagagacgttatggggcttgtggacctgctccatgcagaccgtcagatcaggctgacgcctggcgagcatttcgcagattcgcgcataacgctgtgcattcattaggctagtttcggttacgggtgactttaatcacgtccggcaatacgcggattttacgcatgatgtttgccagatgaacacgatcctgcgcggtcaggcggataaaggcgctgtacacgcggccatctttttcttcagtattcaggctctgaatattggaagaggccgtgttgattgccgcagtcaggtttgcgagcgcaccctggtggttaaacatatccaccttaatttcggtgataaattcctgcgccgtgtctttgtcccactctaccgccataaacttctctggctctttctgatagccacggatgttacggcaggattcatggtggatcaccagtcctttaccagggctgacgtgggcgataatcgggtcgcccggtagtggacggcagcatttcgcgaaggtgatcagtaccccgtctgcgcctttgatcggcagatgtccatggccctgacccgcctgcaccggggctgctgtttcaccctgttgcaggtttttcgcgaccacgacgctcatggcattgccaagaccgatttccgccagcaggtcgtcaagggacgccagcttcatgcgctccagctcatgctgaatattttccggcgggatttccgccagcttgcggctgccgccaagggcatggttaagcagacggcgacccaggcttacggaatcgtcgcgcttgaggtttttcagcatctggcgaattttggcgcgggctttggagctgaccacaaaattgagccatgcggcgttcgggcgggcgccaggtgcggtgatgatctcaaccgtctggccgctggcgagcggctgcgacagcggatacggctgtctgtccacgcgcgcgcccacgcaggcgtggccgatgtcggtatgcacggcataggcgaaatcgaccggggtggcaccggcaggcagctcaacaatgcgcccttccggtgtgaaaacataaatctcatccgggaagagatcagatttaacgctctcgataaattcaaacgaactaccggcgctctgctggagttccagcaggctctgcatccagcgctgcgcgcggatttgcgccgtggtgctactttcaccgtgctctttataagcccagtgcgcggcaacccccatttccgccatcatgtccatgtcttcggtgcggatctgcacctcaaccggcacaccgtgcgggccaatcatcgaggtgtgcaaagactgatagccgttcgcttttggaatggcgatgtaatctttcatgcgccccggacgtggcttgtagaggctgtgcatctgaccgagcacgcggtagcaggtatccagatcgtggacgatgacgcggaaggcgtaaatatccatgatcgagtggaaacgctgctctttcatgaccattttgcagtaaatggagtagagatgcttttcgcgtccgcttacgcgacagggaataccggcttcctgcaaacggccttcgatttcagagaggattttctggatcatctctttacggttaccgcgcgcagatttcaccacctctttgatcacccgatagcggttcgggtgcaacgcctcaaagcccagctcttcaagctcggttttgatgtgatggatacctaaacggtgcgccagcggactgtagatttcgagggtttcacgggcgatgcggcgacgtttatccgggcgcagtgagcccagcgtgcgcatattgtgggtgcggtcagccagtttgatgagaatgacgcggatatcctgcaccatcgccataatcatcttgcggaagttttcggcctgcgcctctttcttgtcgcggaacttaagcttatcaagcttggacaccccttccaccagctcggcaacgcttttgccaaacagctgttccatgtcctggtaggtggcgggggtatcttcaatcacatcatgcagcagcgcggccatcagtgtttcatagtcgagtttcatctcggccagaatacaggctaccgcaaccgggtgcgtgatgtagggttcaccgcttgaacgtgtctggccctcgtgagcgtcacgtgcaacgagatacgcctgctggagacgctttatctgctcttccggcagataggtttgaatcagctgattcaggctttcaaacagatacaagggtgacctgcagtgttattaacgacgaccttcagcaatcgcggtgacggcctgtaattcagcggcttcctgctcttgctgctcctggcgctcacgtacgtcgaggatctggttgttgatcagaccttcttcgatttcgcgcagcgcgataacggtagttttatcgttctcttccgcaaccagcggatctttaccaccaacctgcatctgacgagcgcgacgcgcggcgaccagtaccaggtcaaaacggttaccaattttctctacagcgtcctgaacagttacgcgtgccatacttaaagtgctccacaggtgaagaaatgactgggcatgatactgaaagtacgttcagtctgccaatagtttgctgattaaagcgtcatgtcgctgtttttggcgacccatacgcagacgttcagcacgaataatggtcttcatatcgctgatggcggtatcaaaatcatcattcacaatcagataatcatattcggcgtagtggctcatttctgcaaccgcctgcgccatgcgtttggtgatcacctcttcgctgtcctgaccgcgaccgcgcaggcgacgatccagctcgtctttcgacggcggcagaataaagatgctgcgcgcctgcggcattttctggcggatttgctgcgcgccctgccagtcgatgtcgaggaaaacgtccacgcccgtcgccagaacttgttcaatggcgtcgcgcgaggtgccgtaataattaccaaacacttccgcatgctcaagaaacgcatctctgccaatcatgttcttaaattcatcatgatccacaaagaaatagtgttcaccgtgcacctcacccggacgcggcgcgcgcgtggtgtgtgaaacagaaacctgggtgtcgtacaacggttgggtctttaacaaagcctgaatgaggcttgatttacccgcaccactgggcgcggaaacaatatagagcgtgccttgagccatgagtatcttttgtatgtgatgaacgaacgggaatgtctacatacgtgcctattatacacgtcgccgctacgtgacgtagcctttgtcacacttttgcacgagattattgcgttttgcgaggcgttttcctgaattatctgccgcttgcagcaacagcgcaaaattcccggaagccgcctcgcaaggcggctttttgctgctcgtcttgcgtcagacgtcgcgctataccgaagcgaacacagcaagggaggcagaacatggttaagcgtgtgggatggatactgttcatcttgttcttaagtggcggcagccgggcggcatgcccggtatggccgcctgcacgggcagagcaggagatcgcgcggcttcagcagcaaatcatacagtggaacgacgcctactggcggcagggcaaaagcgacgtcagcgacgaagtttacgataggctcagcgcccggctggcgcactggcagcgctgctttgcgccgcccctgccgcttgatgaacctgcaccgccgggcacaggcgccatcctgcatccggtcgcccatacgggcgtaaagaaactcgcggataaaaccgccctgacgcaatggatggcaaacaagcgcgacctgtgggtccagccgaaagtggacggcgtcgccgttacgctggtttatcgtcagggtgaactggcgcaggctatcagccgcggcgatggcctgaaaggtgaagactggacgaataaagtgcggcagatcccctcgttgcccaaaaagataaacggcccgctggcaaacagtgtcctgcagggcgagatttttcttctgcgtgataaccaccgccagcaggaaatgggcggcatgaatgcgagggcaaaagtggctggcgcgctgatgcggcaggggccttcccctctaacccgcgaactggggctgtttatctgggcatggccggacggcccacaggatatggcgcaacgtctacaacagcttaacgaggcgggctttaagtgggttttgcagttcagccagccggtaaaagacgcgggtgacgtggaaacccttcgcgcccgttggtttgccgcgccgctcccctttgtcactgacggcgtgatcgtcagagcggcgcgtgaaccggcaggtcagcagtggttgccggggcagggcgactgggtggtggcatggaaatatccgccagcggtacaggtggcggaagtgaaaaatatccgctttaacgtcgggcgcagcgggaaaatcgcggtggtggcagagcttgagccggtacagctggatgataaacgtgtggggcgggtcaatatcggctcggtccggcgttggcaggagctggacatcgcccccggcgatcagctgcaaatcagccttgccggccaggggatcccacggattgacggcgtggcatggcgcaacgcttcgcgggacaagcccgcgccgccctcatcccgttttaattcgctgacctgtttttatgcggcgccagagtgtgaagcgcaatttctggcccgtctggagtggctaagctctccgcaggcgctggatttaaccgggctgggggaggcagcctggcgcacgctgcaccaggcctggcggtttgagcatatattttcctggctgatgttaacgcctcagcagttgcagcatacgccggggatctcaccggccagagggcaaaaactgtggcatcagtttgagctggcccgtaagcgcccgtttattcgctgggttatcgccctgggtacgccgctgtctcagggcgcgctgaaggctgcgggagattatcgctggcaacaactgctggaacgaactgaacagcaatggcagcaactgcccggtatcggacaggaaaaagccgggcaactggtggcctttacgcaccatgccgcgctggaaaagctgacggcatggctgggcgaacagggaatgaacggcttttaatacggcggcttaatgtacgttatgcgtgtagtgaaagacgggtaaacccagcttcaggcgcagcgccagcaggcgggcggtaaaaccaaacagcagggtggcgatgaccaccacgtcatgactggagacataatgttgcagagcaatatagagcaccgcagaggcaaaggcgacgccagcgtacagctctttctgaaacaccagcggaatacgtttgcagaacatatcccgcagtacgccgccgaagacgccggtcacgactgcggcaatagtagcgatgatcggcccttcgcccatatcgagcgcaatctgcgccccgatgatggaaaacaccaccaggcccagcgcgtccagcaccagaaacagacggcgaagatggggcataacaggcgcggcaatagtcgtcagcaccgcagcggtggcgacgataatcacgtattccgggttttttacccagccaagcgggtaatgccccagcagaatatcgcgcacggaaccgccgccaagggcagtcgcggtggcgataataatgacgccaaaagtatccatacggcgacgcccggccgccagcgcacctgtcatggcttcagcggtgatcccgataatataaagaatgtgtaacagcatgcgcgcccccgttagtgaaggcgcagggtagcgagtagtggcagggatctcgattgagattttttcagggtcagtctaatcgattactataacttatgcattttttgaccagcactgccttcagaagcagaaaagccaataaaaatgcattagaaattgtatggcatatctcgggcttaacggaaaatttctttaaacattggcaccagtacgcggttgcctgtttcgctcagatgattgtcatcaaaatagagaggctgcaggtttttactgcccatacagcggccatctgtacataaccagcgggaaggatcgataaccttaacgccacactgattgactgctctgtcctgcgcctgccagataaattctgttttcttacgatactccgcctcctggatggagacatcctgcggctgtttacccatcatcagagcatgggaaaggtagcggggtacattgacattcatttcagggacaggacgaacgaggtaaactttatgatgttgattcagcgcgcaggccatcgagatcatcgactcggcataagtatgcaaatactggatcccaacgatgttcttatcatcaaaatgcaccagatggctttcggcataatgacccagcctgttgacgataaccaccggtgttgtggacgggatatccgcaagccgtgcggcaagggatttgttgaatttgtaacagccttcgtttttatcgacgtgggcatcagaaaggttagggcatccggaccatgtcatacccatcaccgaaccatgcccctgtgcggcggcggcaagcgctgtggctgtggcctcggcatgactgtcacccacgataacggcagccagcggccctgtaccgtaataactgagcgacgttttaggatcggctgcgcggtttttattttcggcttcgttggcaatctgattaaccaacggattgggagaattcaccagcgtttgatacttaacgagattgccaaaaatataacagcctgacaccgttgccagcaccaccagccagaatgccggagcagataagcgggacagggacttgttcgccggttgctcaattaatacccatgacaaccagcccagcagaaatgagagtgctatgccgctggtgatccataacgcattgtgctggcgatcggcgtagacaataaaaacggcgatcggccagtgccacaaatacaccgaatatgagctaagaccaatccaccgacaatggcgatcgatactttctgccagcggttggtaattgcttgcgatgaccagcatagtgcccagcacgggaaaaagcgtcaggtatccgggccaggcgccatccggcgtaatcagcaccactgaggcggctattatcagataaccgaccagtgcgcagaggcgtgcccgggcgcgggagaaggtataacgctgtgaaataaaccacaccagaccgccgcagagcatctcccatgcgcgaaacggcatcagataaaacagagaagaaagatttcctgcgctggcataaatcacacagccgataaaagagcatatggcgagcagcattaatgaaaacatcatgctgatgcgttttctgaccagatgtaacgccattaataacagcggcagtgccagataaaactgccattctaccgagagagaccatgtatggaggagccagttttcatgtgaactggtagcaaaatatcctcctgcatctttatttaattttatgttagaaataaagaggatagcgtagctaatgtagttaccgagtcgccggaattcgagcgctggtagccagaaccacatcaataatggcaacagaagacacaacgccagaagcgccggaataatccttttacaacgcgcggtataaaatcgccgcaaactgaatgtctgcgcttccagccctccggcgatgatttttgtcatcagaaaaccagagataacaaaaaacacatctactgcggcaaagccaccgggtaataactgtgcggcaaagtggtaaaaaacaacggatacaatggcgatcccgcgtagcagattaatgtcctgacggaactgactatcgactgagtagcgttcagtgctctcaattgataaagaaagatttgccatgccataacctgtgaaatgtctgtgcggaaccagaaaggcggcgagtataccaagcttcataagaagtttcttagcgttacccgccgtaatggtaataaaatatgatcttattaacagattttttctaaaaagggagtaatgcggaaaggttaaatgccgtgccctgaataataaaagcccgtcatcaggcgggctttttaaagggattaagttactgatgaatattactattcgatattctggatctgctcacgcatctgttcgatcagcactttcagctcaatcgcagaattggtcacatcagcgttgatggatttggacgccagggtgttcgactcgcggttaaactcctgcatcataaagtccagacggcggcctaccgcttctttcttcttaagaatgttgtaggtttcttttacgtgggcttcgaggcgatcgagttcttcagcgacatcaatacgctgcgccatcagcaccagttcctgctcaagacgattattttccagctgtacctgggcgtcttccagtttggcgaccagacgctcgcgctgccatttcagcacttccggcatctgcgcacgtaccttagccacttcctggctcacgccttcaagacgctgctcaatcagggttttcagcgcctggccttcggtttcgcgggcgatgataaagtcgtccagcgcgccgtcgagagccgagaggatttctgcggcgatcacgtccagatcctgttcctgcgcggccatcacgccaggccagcggagaatatccaccggattgatttcgccttcatcgctctgcattttgacccagttcgcggcggtcaccagctgcttagccagtttttcattcaggatcagttcgctctgcgcgctgacgtcaggctcaaaacgcaggttacattcgattttgccgcgcgtcagacgcgtgcggatccgctcgcgcactacgggttcgaggctgcgaaactgttccggcaggcggaaccaggtttccagataacgctggtttaccgagcgcaattcccagactgcgctgccccattcacccttgatttcacggcgggcgtaggctgtcatactgcggatcataaacgttcctgttttgaaggagagatggggggattatagctttcagggcttacacaggataggaataagcgactttaatccgtataatgcgcagccacattcgtagaagccggagaaatcatcatgcgtccagcaggccgtagtgccaatcaggtgcgtcccgtcaccctgacccgaaattatacaaaacacgctgaaggttccgtgctcgtcgaattcggtgataccaaagttctgtgcaccgcgtccattgacgaaggcgtgccgcgtttcctgaaaggtcagggacagggctggatcaccgccgaatacggcatgttaccccgtgcgacgcatacccgtaacgcgcgcgaggcggccaaaggtaaacagggcggccgtaccctggaaattcagcgcctgattgcccgttcactgcgcgccgccgtggatctgaaagcactgggcgagttcaccatcacgctggactgcgatgtgatccaggcggatggcggcacccgtaccgcgtctatcaccggtgcctgtgtggcgctggccgacgcgctgaacaagctggtggcagcaggtaagcttaaaaccaacccgatgaagggcatggtcgccgcggtatccgtgggcatcgtcaagggtgaagcgctgtgcgatctggagtatgttgaagactccgccgctgaaaccgacatgaacgtggtgatgacggaagatggccgcatcattgaagtgcagggcaccgccgaaggcgagccattcacccacgaagagttgctctcgttgctggctctggcccggggaggcatcgaatccatcgtcgccatgcagaaggcggcgttagaaaattgattttaaggcgacttgatagtcgccttttttatgtctgaaaaaagcttaaggagcaaatccatgaaaccgtatcagcgccagtttattgaatttgcgcttaacaagcaggtactgaaatttggtgaatttaccctgaaatccgggcgcaaaagtccgtatttctttaatgccgggctgtttaacacgggccgcgacctggcgctgttaggccgtttttatgccgaagcgctggtggactccggcattgattttgacctgttgtttggcccggcttacaaaggcattcccattgccaccaccaccgcagttgcgcttgcggaacaccatgagcgtgatgtgccctactgctttaaccgtaaagaagccaaagatcacggcgaaggcggaagccttgtggggagcgcgttacagggccgcattatgctggtggatgatgtgatcactgccggaaccgccatccgcgagtcgatggagattattcaggcgcatggcgcgaccctggcgggtgtgctgatctcccttgaccgtcaggaacgcggacgcggcgagatttcggcgatccaggaagtcgagcgtgactatggctgccaggtgatttcaatcatcacgctgaaagacctgattgcgtatctggaagaaaagcctgagatggcggatcatctggcatcggtacaggcgtaccgcgatgaatttggcgtttaaataaattttgcccggtggcgcgacgcgtaccgggcatacttaacgttactgcagctgcgcggccatcagcggccagcgggcgtcaaagtcttctgtcggacggtatttgaactcgctgcgtacaaagcgcgacagcattccctcacagaaggccagtaactggcttgccagcagtgcttcatccacggtatagccttcgccttcacgcatttttcgctcgcgcagtacctggcgcagttgcgattcaatacgatcaaacaactggttaatgcgaccctgcaggcgatcctgctcaaacatcagcgcgtgaccggtcagaatgcgcgtcaggcctggattacgttcaccaaatcccaccaccagcagcacgataagacgcagacgcgtggtcgtgtctttttcgtctttcaggatcaggttaatacgcgtggtcaggctatcttcgataaattcaatcaggctatcgaacatacgcgttttactgggaaaatgacgatataaagccgcttctgaaacgccaacggaggctgccagcttcgccgtcgtaatgcgctggctgccatcgctggattcaagcatcaatgccagagattgaagtatttcttcgcgacgattccttttcgcagtttgtttttctgccatgttccaaaatacccctgaaaataagcacttgtcaggcgggcatccacgcagcgaccgcaaaccgaagtttgcggtaatgttattactttatggcgctgtgggatgcgtttataaagccgcttattgacggcctgaatggccgaagccgccttcaccacgttcggtggcgtcgaaatcttccaccagattaaattctgcctgtaccaccggcacaaaaaccatctgggcgatgcgctcgccaggttcgatggtgaagctggtttgtccgcggttccagacggaaaccatcagttgcccctgataatcggagtcgatcaggcccaccaggttacccagcaccacgccatgtttatgccccagccctgagcgcggcaggatcaccgctgccagcgttgggtcagcaatgtggatcgccagtccggtcggaactaaagtggtggcgcccggcgccagttctacggcgtcatcaagacaggcgcgcaggtcaagaccggcagagccggaggtggcataggttggcagcggaaattcctgcccaacacgcgggtccataatcttaacgtcgatttttttcatcataacgggtaacgatctcgtccagtagttgttggcccagaagtgccttgctctcaagcggtaagactttatcgccgtcctgccagaacaggtgcagtgcgttgttatcgctgttaaaaccctgctgcgcgccggaaacgtcattggcgcaaatcagatccagatttttacggctgcgcttttgccgggcgtattcttccacattattcgtttcggcagcaaacccaacaacataggggcgatgcgcggacagcgcggcgacgcccgctacgatatccgggtttttcaccattttcagtgtgatttcatcgccttgctttttaatcttctcatcggcaacggcggcggcacggtagtctgccacagcggcgcaaccaataaaaatctgctgcgtttgcacattggcctgtactgccgcttccatttccagcgccgtggtgacgtcaatgcgcttaacctgcggcggcgtggcaagcgtgaccggcccgctgaccagcgtgacgttcgcgccacgtcgggcggcagccgcagcaatggcgaagcccattttcccggagctgtgattggtgatgtagcgcaccggatccagcggctccctggtcgggcctgcggtaatcatgatattcagatgttgcaggtctttgacaggcgaaaaatgcgccgcggccagatcgacaatctccagcgggtcgagcattcgccccgggcctacatcgccacaggcctggctgccgctgtccggcccccagagcagtaagccgcgggaagccagtacgcccagattatgctgggtggcggcggcgcggtacatctgctggttcatggctggcaccacggcgaccggagacggagtggcaagacaaatggtcgataccaggtcattggccatcccggcggcaacgcgggcgattaaatccgcggtggcgggggccaggatcaccagatcggcccattttcccagttcgatatgccccattgccgcttcggctgccggatcgagcaggctgtcggaaaccggatagcctgacaccgcctgtaaactcatgggcgtgataaaggctttggcggcctcggtcatggcgacacgcacctccgcgccgcgatcgcgcagacggcgcaccagctctggcgctttataggctgcgataccgccgctgacgccaagaacgatttttttaccggccagactcatcatgattctttcctgttggatttcaccagaaggcgggcattttatcacaatcctccacctggcgtgcttttgcgcattgcgcactttgcgaggcgctacgcaaagccgttaacccgctttgtggcaggataggcgctcgacagggaggtgacattatggaagaaacgttatctatactaccgcgtgaaaaaacgctgctgtttggcgtcaaatcgctcagcgatgttgaattactggcgctgtttttacgcaccggcacacccggaaaaaatgtcatggcgctggcgcaccatctgctggggcattttggctcgctgtatggtctgctgaccgcggaatttgaaacgttcagcgaggtgggcggcattgggctggcaaagtatgcccaactgaaaggcattgccgaactggcgcgccgtttctatgaggttaaggtggcagaggagtttgccatcatgtccccggatgtcgcattagcctttataaaaagtcagttaacggcggaagagcgcgagatctttatggtgatctatcttgataaccagaaccggatcctcaagcactgccgcctttttaccggcactatcgccaatgttgaggtgcatccgcgtgaaattgtccgcgaagccatcaaaattaatgccgtcggcgtgatccttgcgcataatcatccttcgggcagcgcggagcccagtaaatccgataaaatcatcaccgaacatgtggtaaagtgctgccagttcatggacatccgggtggtagatcatctggtaattggccgtggagagtatgtttcatttgccgaacgtggctggatttaggccactttacgcgatccattgggatctttgtctgttcgggacttgagcacatcgattacacagcgtatactacgccacctttgagaatctcgggtttggcattatgggcctggcattgtgggttcacattgaaccgccagaggccaggtttgcagcctgacgaggcgccataaccctatacgaagctcgagctaatttgatttttggagaatagacatgtcccgagtctgccaagttactggcaagcgtccggtgaccggtaataaccgttcccacgcactgaacgcgaccaaacgccgtttcctgccgaacctgcactctcaccgtttttgggttgagagcgagaagcgttttgtcacactgcgtgtatctgctaaaggtatgcgtgtaatcgataaaaaaggcattgatacagttctgtccgaactgcgtgcccgtggcgaaaagtactaagtacttagaggaaataaatcatggctaaaggtattcgtgagaaaatcaagctggtttcttctgctggtactggtcacttctataccaccacgaagaacaagcgcactaagccggaaaaactggaactgaaaaaattcgatccagttgtccgtcagcacgtgctttacaaagaagcaaaaattaaataattttcgctttgatgtacaagaaccccgcctgtgcggggttttttgcattcagcctccggagaaatcatgcctgaattacctgaagtggaaaccagccgccgtggcattgagccgcatctggtgggtgaaactattctgcatgctgtcgtgcgcaacggacgcctgcgctggcctgtttccgatgaaatccatgccctgagcgacaaaccggtgctgagcgtgcagcgtcgcgccaaatatctgctgctggagctgcctgacggctggatcatcatccatctcggcatgtccgggagtctgcgtatcctgccctatgaaatgccggcagaaaaacatgaccatgtcgatctggtgatgagcaacggcaaagtgctgcgctacaccgatccgcgccgctttggcgcctggttgtggacgtcgtcccttgaagggcacaacgtgctggcgcatttaggccccgagccgctcagcgatgcctttaacgccgactatctgcgccagaaaagcgcgaagaagaagatcgccatcaagccctggctgatggataacaagctggtggtaggggtgggtaacatttacgccagtgagtcgctatttgccgccgggatccatcccgatcgtctggcgtcgtcgttgtcggcggaggagtgcgaattactggtgcgggtgatcaaggccgtgctgttgcgctctatcgagcagggcggcaccacgctgaaagacttcctgcaaagcgacggtaaaccgggttactttgcccaggagctacaggtgtatggccgggaaggtcagccgtgccggatctgcgccgcgcccatagtggccagcaaacatgcccagcgctccaccttttactgccgcaactgccagaagtaaaacctccgggcgctacgcctgcagcttagcgagtagcgcctgatgtacctgcgcaggcaggaagtgggtgacgtcgccatgatgacgggccacttccttgaccagcgatgacgagataaacgaccactcttttgacggcatcaggaagacgctttccagatccggcatcaggtgacggttcatttgagcgagctgcatttcatattcgaagtcagccactgcccgcagaccgcgaatgaggatattggcctgctgatcgcgggcgaaattcgccatcaaatcgctaaaaccgacgacttcaacgttagccagatgcgcggtggcctgacgcgccatttcaacgcgttcatccaggctaaacagcggtttcttccccggactggcggcaatcgccatgatgaccttgtcaaacatgcaggccgcacgggtgatgatgtcaacatggccgttggtgatgggatcgaaagtgccgggataaatggcttttgtcgtcatggcgcgctcttttctgagtagccgtggttcagcgcccacagcccggtatatttattaaaagtatactgcgcattcaccacggccagcagccagccctgtttgccgtcgagcacgccgccgcgcagcaccagcgttttcataaacgcgccgatcgtatgcgcaaagatacctgtaatgctggtcttcttgccctgctgatggtgctctttcgcccaggcggtggcgtagttgaactgcttttgctggaaactggcaaagtcgcggcaggtcagatgcagcagatcgccctgcaggtttaccatcgacgcacctgcgctttccagggattcatgcacggcattgctgttgtactgatacttttcccgcggatacagacgcatcacgcgatccgggtaccagccgctgtggcgcataaaacggccaagaaaatagttacggcgggcaatgctgtagatggtatctggcgcaggggaggccagcacgccctgaatggcccgggcgagttccggcgtgatgcgctcgtcggtgtcgatcatcagcacataatcgcccgtggcatacgcctgcgcccgctggcgctgaataccgtagccctgccagtcggtattggtgaagaccttgaccccggcgttgcgggcgatagtgagggtgtcatcggtgctgccggagtccagcagcacgatctcatcggcaaaggccaccgaagccaggcaatccggcaacagatcggcggcgtttttggcgatcatcaccaccgagaggcgcattagtggctccgctgcggcagataaggttgcaggagttgcagcagtcgtgagagcgcgccctgattctggtgcagcacctcaacggcatggcggccgtaccacaggcgataatcttcatcggtcagcaaggtcgagacttctttcaccagcgaatccgcatcggtaacggtgatcagaccatccgcctgttgcaacttggcgcaaatatctttgaagttgaaggtgtgcgggcccatcagcaccggaatggcatgcgccgccggctccagcgggttatgcccgccgcgctccaccaggctgccgcccacaaacgccagatcggcaatgccgtacagcagcatcagctcgcccatggtatcgccaatcaccacctgcgtgctgccggacgggatctcgccggtgctgcgcagggtaaagctgaagccgcctttctgcaccatatcgcgcgcgtctttaaaacgctccggatggcgcggcaccaggatcagcagtaaatcggggaaggtttccagcagcttgcggtgcgcctgaagaataatctcttcttcgccatcgtgggtgctggtggcgatccacacctgacggcgcggcgcccactgtcggcgcagcgtaatggcgcgcgccgccagctccggcgtaacggaaatatcaaatttgagactaccggtgacggccagctgattacgtttgaggccgagcttcaggaagcgatcggcgtcttcgtcattctgggcggcgatcagcgtaattttgcccagcaggcggcgcataaagttgcccagcttgccgtaaccttttgctgagcgttccgacaggcgggcgttggcgatcaccagcgggattttacgggcatgcagcgcggaaatcatattcggccacagctcggtttccataacgatgacaagctttggccgcacggtggcgagaaagcggttcatcgcgcagggtaaatcgtaaggcagatagacgtgatgcacgtctttgccgaaggccgacatcacgcgctccgagccggtgggcgtcatggtggtcacggtgatgggtaacgcaggataacggtggcgcagcgcacgcaccagcggaatggccgccagggtttcccccaccgacacggaatgcagaagaataccgtccggcttcactttgttactgcaatagccatagcgttcagcccagcgtttacgatacgcgggagccttgcggctgcgaagcaacaaacgcagccacaccagcggctggataagatagagcagggcggtatacaacaattccaagcgattatccgttttttgagtttcggcgggcaaattctaagcattaaagcgggctaaagctatacttttggcgcttttggtcacgcttttgccactgtttcgtacaatgcgaaaggggaaaacgaagaaccactggacggcacagggcagaaaagccctgtgcgcgggaaaaacgattactgctctgctggcgggagttcgttcagatgataggtgatccgctccgaaagaccccgaatatcaccgccggtgatgaagtagctgtcatctttctgattcgggttcgtcacctgataacccagcactttattgatcagcgtcgccagctggaaatggttcagcggcatctgcgggctgatgtttttcagggacatcgccggatcgttactgaaatagatgaacggcacctgcgcaatcggcatttccacgacggagtgcccgaacagcccgccgtccccgacgcgttcaccatgatcggaggtgataaagaccagcaccggcagtttcgatttcgccatcaccgtacggatcgcagaagccagctccttgtcgtaaagacgaacggcatcgtcatattcattttttttctgcgccacgtcatcatcaagatgcggggtggaaaacttcgcgaatccggccggaatgtttcgctcataaggaatatgcggtgcgcggctgttcagcaccatcatgaagggtttattccagtccagcggggctttttcaacggacggggtgaggatccggtcagcgcccacatccggggccggacgcacctgcgtatcttcccaaaaatcgatgtcatgaatgccaatccagttgctcagcccttccagaccctgcgctgaaataaacgcggtctgataaccctgtttcttcgcattggcaaaaatattggtcgctttgcttttatacgctgagaagttatccggctcgcgcaggttattgaccagcatcggaatggcgacacgtgtggagacggcgttagagacaatcagacgtccactgccctggtattgatccatcagcgctttcagttctggcgtggtctctctttcatagccgagcgcgctgacatgatgcgggttcagactctcgccaatggccaggatcaccgaatatttcccgttctggtggtctgcaaccggcgtgacctggtaaggctcgtaatgggcgatattctggttttcgcccgacagcgcttcggggatcagccttaccgcgctaaagctcatcgctgacaggccgttgcgcagcagggagtggcgcaggtcaggattgaatttatacatctggccgtcgatggctttgtagaactggcctaaaaacatcaccgctatcgccagcaggcagggggcggcaacccatttgtgccagtgcggcccaatacggcgggcaaacaccagcgcgaagacgatcgccaccagcatgatcacaaaataaatgcccagcgcaccgaggctgtcagtaatgccgctggcaatatctttcgtttcaacaaacgccagccacacttcgctcgggccatagaactggccataaaactggtggtagatcgcctcagatagctgcacgatataggtgatcgccagcagaacgcgcgtcagcataaaacggatgctgaccgccgcaagcagagagatgatcacatacagcgcaatatcacccgatttcgggctgtatgccgtgtctttaaggctgacaataatttcggaaagcgcaaaaaacgccgtaaaaatcagcgtaagagtaatggtcttaagcagatttcgtcccaacgaagggcgggacagcaatgacgatctgaacatgttttaacccgaatggttttagaatttcttggtcaggggacgaatggctttaccaaaaccaaagcgcaccgcgcgcacgaacgtcggacggttatgtaagcctttacgccagatatcctcaaacaaggcataccagcgggcagctacggcttcacgggagtaaacctgtagccgtttttcgccctgctcgcgcatttgacggaataactccggcgagtttttcagtcgcatgatggcggcaaaggcttcgtcagggtttttggcaatcagataatccagttcgctctcgcgaatagcgcggaatgacggctcgtcatcgcacaccatgactgttttacccagccagttattgatgagtttgctggctggcttacgggccagcttgtggtcatgagatttgcggaagctcacgcagacatccacatcgcggtaatccacccagttatcaaaggagatacgcagggtgatgccctgttctgcaagacgttgtttaaacgcttcgctgcggtactcttccgggaagctgtccacccggccaaagtaggccaccgtctgcacgctatcatcggtgcgctcgcgcggctgaacgcctggctgcggccagtagggcacgaaaatgcggttgctgtggccgtcaacttccgggttctgatcgacaacatagtctgcgcctattaccggcgggcggtcggcgcgggcgacgacagtgacgcctttccagggtttgacccgtgagccgaagtcatcgttatgcatcagattgatcgcatcaggacggcattcggaaccgaatgaacactcgattgcatcaccgtaatagtgcttcagagcaagcgtggtctggaatgtccagccaccgcgtccgccgcaatagaaacgttcaggaatggtgttcggatccgttcctgcggcaagcagcgcatcaaaatcggcgtagtttttggcgataaagtccgcccgggatacggcgtgcaatttaagcttattcataggttcgctttatttaatcagtttcttaagacgaaagtaacggcgtcccagacgccagcgctgacggaaaccgcgcgcattttgccagatcatggaccagatcccgcgggaaaacagctctgcggtgatctcacgctttttcgccgcatcctcaatgttattgatgctgtgcagaatacccagcccctctttggcaatttgccagtggcaggcgggtacgcgcttaacctgtcgcggataacgctggttaatcgcatgcagcatctcaaggattttcatgtagtgccgagccgagcgcatacgggtgtcgtcggtgcccggagtatgggacacggaagccgaatgaatcaggtagtcgtaataggtttcgtcgatgtactgcacacgtttcgcggtcagcagcacttccgttgtccagggaatatcctgatggcgcagaccatgctcgaaggtaaaaccctgcgctttgataaaagcatggcgatagatgttcagccaggtcacatgcaggaatttacgtgacgacagcgctttttgcagccaggtcggcccatccagcacgcccgttgagggcagcttatcggacgggaaaatcttcttcgccgggcggccatcatcgtaaatgtaggtgccattacaggttgccacatccagatcgccctttctggctatttccagcaggcgggtatacatccccggatagatcacatcgtcaatatccggaaacgcaatgtactcacctcgggcaaccgccagcccggtattgcgtgccgctgaaaccccctgattgggctgatcgataacctgataatcgctgaattcatcggcgtagcgggcaatgatcgccgcagaattatcggtcgaaccgtcgtttacgataatcaattcgaggctgttcaggttctgacttttgatgctgtcaaaaaaagcgctcagaaacttttcaccattatagacggcgacaacgaggctcaattgcggggtatctgacatgctttctccgtaaaagcgggcaatgcggtggcttttcgacagccattatctgaatgagttctgccggggtatggcagcaccagcggtggctattatctactaagtgataaagaaaaccactggtgcaggaacattaccatcaggaagtgggctgtttctcattgcgcggcgtcaacgagcagatgccgataagcaggccggtgagcatcatatattgctcaaggtagtgatccttaaggttatgatcgaccagcgtacgtgagaagaagcctaccgtgaacagcagcaggaacatgcctgccatggtgttgccgcggcggaactgccgccatccgatataccagcagcccatcagcaaaatcagccagcccgcaatccccgcaatgccgttttgcagaccaaattcgattaagccgtagtggctgtgcggaacagtaatgaaatcggaacccgtatcgcgacgcaggatgtaattaaaggcctctttacgcgggcccatgcctgccgggtgctcggctatgatcttccagcctgtgtgaaagaaactggcgcggcagccattagaatgattcatctggacgccaaggctatttttgggcacaacaccaatgacattgttgtagcaaaaactgtttaacggcgcattccatccggcaatggcatcactctcaagcgtttgccagcgcggatcggttttccatgaggcataacctaatgtcaaagaggcggcgataaatagcactaatatagtgcccatcagcacgactttactacggcgcatatgatgcacaccaagcagaacaaaggttgaaaacaggctgcccactagcccaatggttccccatcgcgtatctataagggcggtacaaaccaggttagacaataaaatcgctaccagtactggtgtgttcagacgcaggaaacgctggtgtagtaaacctcgggccagcaactcggcaatcagaaaaccggtgatcatattcacctggaagctcatacgggtgcggttaaagacgatccgtgtttccccccagtgaatatacccatcacgccagtacagccagagggtatccagcagatggatacagatgacgccccagaagaataaaacgatcagcgtaaacagacgggccgcggaaaagttggggaaggcggtttgtatggcaggtaacatgaccataccggcacagaatagcaggaccggtcgtaaccactggccgctccacgccgaaaccatttctttaatatcgggagtgacaacaaagccattaatcagaataaagaaagttaatacccagacggcaataagaacaaacttaatctgtctgaaatttaaacgggtgcgggcttcaggtgaagaaaagaaaaggccaacagataaagcaattaaaggataaatcaggccatttcgatgaaacggtaattgatcgttaggaatcggccaggcgaagcataatgctaatgtatagagaactaacaggcctgtcaggatgttacgagttttcgtcataattatttaggctagttaaggatttcggcgtggtgaccgggtagtaacgcagcagcacaagaattccacgacagggcggagagatttgtgaaagcgcaggaaaattaccatagatagcacaacttaagaagaataatgtttgtaagtaagattatcactgagcgggcgatgaatgtgcgtcaggcgggcctgcaagtatataatgattcgattaatgaggtcgttagccactcacaggaagcgtatgcatattgttcacacagaagccgatggcggtaagggcggtcagccattgcgcatcatcaatgagtcactgggtatgatccagcgtggtcatcaggtgaccattctttgtccggagagcgcgccgctgcatgcgctggcgcagaatgccgggctgacggtggtgacgcttccgctcaggcggaaaaatgtgccgaacctgctggcgttacgccgctggctgcaggccaaccggcagactgtggacgtggtcaatagccataactcagccgatacctggctggtggcgctggcgaacctgacgctctcacgcccggtgccgctggtgcgcacccgtcatgcatccggtttaccgcgcaataatgccggcagccgctggctgttccgcaccgcctgcgcgcatatcgtcaccacgggcgaagcgctgcggcatcagatgacggcgattggcgtgccgctggaacaaaccacctccgtacccagcggcgtcgatccggcacgttttcatccggcggataaacaggcggcgcgccagcagtgcggtctgtcggcggatgatttctggctcggcgtggtgtcgcacctgcgccccaacaaaggccacagcgtgttgctggaggcgctggcgcagatctctgatccaacgatcaagctggcgattgtcggcgaaggtccacaccgtgcggcgctggagcaggaaatcgtacggttgggcttgaccgatcgcgtgctgatggcggggcatcaggctgcgccggagaagtggttcccggcgtttgatattgcgttaagcccgtcccacgatatggaaggcgtgccgcagggcgtactgcaatccctcgccagccgcattgccaccattgccaccgacgcgggcggtacggcggatgcggtgattgaccgccagactggcctgctggtcggccagcgtgatgccggggcgctgcgtgatgcgattgtcacgctgcacaaagatgctgcgcttcgcgaccagctggcgcagcaggggtatgattatcttctcgcccatctcacgcgggactgtatgttaagcgcgatggaaaaggttttttccgacgcgattcagcgtaacagctcgcgataaagcgcctgtaactcctgcgccatgcggtcgagcgtccagggctcggcggtggtgcgggcatttatggcgtacgcttttcccgcctcgcgacccgacagccattcgccgatagcctgccggtagccggaaacgtccagcgcatcgcgcacccagccgttttccccttcgcggatccattccgccgccccgcatccggggctggtaaacagcggtaatccgcaggccagcgcttccacgcagacatttggaaagggatcgtaaagggtaggcaggatcagcgcatccgccgtgccgtagacctggcgcacatccgccaccgggccgagaaattttacccgatccgccacgcccagcgactgcgcctgcttttcaaatttacgggcatttttatcgcgtccggcgaccagcagccagacgccgggatgcgccgcgatggccgccagcgctgtcgccacgcctttacgcgcaaagccggaaccgacgtaggccagcaccggcgcatcggctgggatcgccagcgtctcccgcatcgtcagcctgcgcacgtccggatggaaatgggcggtatcgacgccgttataaatcaccgtcagcctgtcagcgggcagacggaagcgacgaacaatgtcatcccgtaccatcttagagttgcagatcactttgcgcagcgccggatgggtgaacatcgcctgctccgcctgcaaaatgtagcggtgataggggctgaaggactgcgaccagcgcttcggcagcgacagaatgcggctgtactgttcaagccaggtggcgtgcacgccgtcaccggcgcggaaaatggtggcgccgggaatacgctcgtggctctgcacaatgtcgaagcggttaaacagctgagacgccgcgcgggcaaagccagcttcccgggcggtgcggttacggaagggcggatcgacggtcagcgtctgccagccggtggcgttctcccactggcgggcgatcagcgtgacgtccagcgaactgtcgcccgccagggtattcagggcgcgggaaacaaaccgctccgcgccgccgttggggttataggtctgtcggacaatcgccagtttcatgccggattttccagtagcagcgtatcaatggcgctcagcacctgctgtggcgtaatggcggtgatgcagtccgacacgccgctgtcgccgcagcctgctttcccgcagggctggcaggtaaagcccgcaataatcacccggtaggccacgccccagggtgcccacttaatcgctccggtcgggccaaaaatggccaccgtcggcgttcccacggcgctggccagatgcatcggcatcgagtcgacgccaaagtagagccgcgcatgtttcatcagcgcgcccagctctttcagattcagctgtccgctgagatcgaacaccggctgcgtcagcgcagcgcgcagctgatccatataggcggtttcttctttcgaaggtgcagcggagaggatcaccggaatgccgcgtgcggcaatggcatccacggtggccgccagcttgtcaatctgccaggccttgaacatccagcgtgaggtgggatgcaccagcacataatctttccccaccaggccaaaccccgccagcttgttcagcacggaggtttccgcgtcctcgcccggcacgaacagcgtgcgtttgtcttccacgctcgccggatggatgccaatgcggcggagcgcgtcgaggttcacttccaccatgtgacggctgttgtcctggatcgccggatagagcgtggtaaaagatttcacccagcgccagcgcgccagcccgctacgtttatccggcttaaagccgacggaaacgcgcggcttcagcttgcgtgccagccgtgcgccgtgccagtgctcggtcaggttgattagcacgtcataatcccgcgctttcagggtgttacgcagctggcgatacaggctcagctgcttcagccagccctgtttacgccagttacgcccgatggtgtgcacctgatcgatataggggtggctggtgagcatcgcctgcgtatcgtcatagaccagcgcgtccacttccacgcccggccagttttttttcagcacggtaaacagcggcgaggttaaaagcacatcaccatgatgacgaagcttgatgatcagtacccgtttcggcgggcgttcagccgtgaaaaagtcagacatggacattctctgttgccagcaagggctgtaatttttccaggaccgcagcggcggggagatcgcttaactgcgatgaatgttcagggcggcaaacgacctgatttttgccataaccgccaattaatcccggatcggtcgggccatataacgtgatattaggacgatcaagggcggcggtcagatggcttaatccggtgtccaccgacaccacaaaggcagcgcctgccagttcgcgcgccaccttttccagactcatgcgcggcagtacctcaacgtgatccatatcctgcgtcagccgttttgcgcgcgcttcttcgtgggcggctccccagggcagcttgatgcgcagtccggtgggctgcaacaaggcgatcagctcgcgccagtgggactcaggccagtgcttatcatcgcgggtagtggcatgcaggaacacggcgtaagaagcaggttgcgtctggtcggtcaggaagtgctgcgcaatgccgtaatcgccctgggtttgcggtcgggcataacccagactacgggcgaacagctcgcgggtgcgttccaccgcgtgctgcgctttggcgatggcatggcgacggttataaaacaggctcgccagcggctcgcgggcgctgtgccagtccataccatgcttcacgccgcgcgccaggcgcgtcaccagcgctgcgcttttcaccaggccctgcgcatcaataatagcgtcgtattgtacagcgcggatggcgtcacgaaatttctgccgttcgacgcggatcggcgcggaaaaccacgccttacgccagcggcggatcgccaccgggatcacgcgatcgacggcggcatgccagccggggatctgcgcgaagccctcttccaccacccagtcaaaacgaatgccaggaatagcctgcatggcgtcggttaacgcgggcagcgtatgcagcacatcgcccatcgacgaggtttttacgatcagaacccgcatccgttacccttcttccgccagcagtaaagcattaagttcattaagcacccgctcaggcgtaatgtcgatcaggctctggtgatagccctgctcgctgtcgcctttgcggactttgtgatagccggtgatcagacgaataacccgggctttatgcgacagcggcggggtaaaatcggggctgctggggccgtacagcgccaccagcgggcgattcagggccgcggcgacgtgcatcaggccggagtcattcgtcaccacggctttacaggcggcgagtaaaatcactgcctgctccagctgagtttcaccggcgaggttgcggcaccaggcctgctgctcaatgctcagggcggcgaggatctcattaccggcgtcgtgatctttcgccgatccgaacagcaccacctgataaccttcgtcgatcagctgcttagccagctctgcgtaatggtagtgcggccagcgttttgccgggccgaattccgcgccggggcaaaagccgatcaggggacgttcagcggagaggccaaacgcatcacaggtccgggctttttccgcctccgtaacctgcaactgcggccacagcagcggctgcggcagatctttcgccgactgcatcacgcctttgtcccaggccagggccacatagcgttccaccatcagcggccaggcttgtttatccagcacgcgggcgtcgttgagcacgccataacgcatttcaccgcgccagccggtacggtgcgggatgcccgcaaagaacggcaccagcgcggatttaaaggagttcggcaggacgtaagcgcgatcgtaacgtcgctcacgcaggctgtgcccgagcctgcgccgctcgccaagctcaagcgcgccgtgccccagcggcatggcaatcgcctcgttgacttccggcatgcgcgacaataacggacggcaccacgcgggtgccatcacgtcaataatcgcctggggatagcgcgccctgagcgtgcgatagagactttgcgacatcatcatgtcgcccacccatgacgggcctaccacaaggatcttcatcgtcaggcgtcgcggttcagccaggccatatactccgtcacgccttcggccacggttttgaacggtttatcgtagcctgcggcgcgcaggttagtgagatccgcctgggtgaacgcctggtagcggcctttcagtttttccgggaacggaatgtactcaatgctgccttttttgtggaacgccagggtcgcatcggctaccgcctggaaggactctgcacggccggtgccaaggttgaaaataccggacacgccgttttcccagaaccacaggttgaccgccgccacgtcgcccacgtagacgaaatcgcgcttaaagttttcgctgccttcgaacagcttaggcgtttcgccattgttcaactgggtgttgagatggaaggcgacgctcgccatgctgcctttgtggccttcgcgtgggccataaacgttgaagtagcggaaaccgacaatcggggacgtcgcttccggcaggatttgacgcacatattcatcgaataaaaacttggagtagccgtagacgttcagcggcttctcatattcgcgggattcaataaagtcagaggtacggccgccgtaggtcgccgcagaagaggcatacaggaacggaatgttgcgctccaggcagtagtgcagcacctctttagagtactgatagttgttatccatcatgtacttaccgtcccactcggtagtggacgagcaggcaccttcatggaaaatcgcctcgatatcgccgaactcttcccccgccatcacctggatcaggaagtcttctttatccatatagtcggcgatattcagatccaccaggtttacaaacttggtgccatctttcaggttatccacgaccagaatgtcagtgatgcccttgtcattcagcgctttaacgatgttgctgccgataaagcctgcgccgccggtaacgataatcataactgtgacctttgaattgaggcgcgccgggacaatcccggacacgaatatttcttatcataccatcacattgcagacccttcagccattcaccgccaaccttcccgacgacacgtgatttatgctgcaaaatgaacaatggatgatgcgtcatctcgtatcaacgtatagctttgggtaatatgtgccgaaatttgtccagtctggagaattgcaatgcgtggggatttttacaaacagttaagccatgacctggaaaccgcgcgtgcggaagggttgtttaaagaagaacggatcatcacttcggcgcagcaggcggacattaccgtcggcgacggcagccaggtgatcaacttttgcgccaacaactatctgggcctggcgaaccacccggatctgatcgcggccgccaaagcgggcatggattcacatggtttcggcatggcgtcggtgcgttttatttgcgggacgcaggacagccataaagtgctggagcagaagctggctgaatttctcggcatggaagatgcgatcctgtactcctcctgtttcgacgccaacggcggtctgtttgaaaccctgctgggcgcggaagacgccattatttccgacgcgctgaaccacgcctcgatcattgatggtgtgcgcctgtgtaaagcgaagcgtttccgttacgccaataacgatatgcaggagctggaagcgcgtctgaaagaagcccgcgacggcggcgcgcgtcacgtgctgatcgccaccgacggcgtgttctcaatggacggcgtgatcgccaacctgaaaggcgtgtgcgacctggcggacaaatacgatgcgctggtgatggtggatgattcccacgcggtaggctttgtcggtgaaaatggccgcggcacccatgagtattgcgatgtgatgagccgtgtcgacatcattaccggcaccctcggtaaagccctcggcggcgcatccggcggttatacggcggcacgcaaagaagtggtggaatggctgcgtcagcgctcccgtccgtatctgttctccaactcgctggccccggcgattgtcgccgcctccatcaaagtgctggagatgctggcggaaggcagcgagctgcgtaaccgtctgtggactaacgcgcgcctgttccgcgaaaaaatgaccgccgcaggttttacgctggcgggggccgatcacgccatcatcccggtgatgctgggtgacgccgttgtcgcgcaaaactttgcccgcgaactgcaaaaagaaggcatttacgtcaccggcttcttcttcccggtggtgccaaaaggtcaggcgcgtattcgcacccagatgtcggcggcgcatacccctgagcaaatcgaacgtgcggtggaagcctttacccgcatcggtaaaaaacttggcgtgattgcctgaggacctgtaatgaaagccttatccaagctgaagccagcggaagggatctggatgaccgatgtaccgcagccggacgtcggacataatgatctgctgattaaaatccgtaaaaccgcaatttgcggcacggatgtgcatatttataactgggacgaatggtcacagaagacgatcccggtacctatggtcgtgggccatgagtatgtcggcgaggtggtcggcatcggtcaggaagtgaaaggctttaaaatcggcgatcgcgtttccggcgaagggcatatcacctgtggtcattgccgtaactgccgcggtggtcgtacgcatctgtgccgtaacactatcggcgtgggcgtcaaccgtcagggctgctttgctgaatatctggtgatcccggcgtttaacgccttcaaaatcccggacaatatctccgatgaactggcgtctattttcgatccgttcggcaacgcagtgcatacggcgctctctttcgatctggtgggcgaagatgtgctggtgtccggcgcaggcccgattggcatcatggcggcggcggtggcgaaacacgtcggcgcgcgccatgtcgtcatcaccgatgtgaatgaataccgtctggatctggcgcgtaaaatgggcgttacccgcgcggtcaacgttgccaaagagagcctgaatgacgtgatggccgagctgggcatgaccgaaggttttgacgtgggtctggagatgtccggcgcgccggcggcgttccgcaccatgctcgacaccatgaaccacggcgggcgtattgcgctgctgggtataccgccgtcagagatgtccatcgactggaataaagtgatctttaaaggcctgttcattaaaggcatttacggtcgtgagatgttcgaaacctggtacaaaatggcggcgctcatccagtctggtctggatttaacaccgatcatcactcatcgcttccccattgacgcgttccaggaaggcttcgacgccatgcgttccggccagtcaggaaaagtcattctgagctgggattaaataaaaggcaccttcgggtgcctttttagccccatcacatctttctgcatttttaatagcgaaagcatgatttctttatcaccttttttaatatccggttataacatgcattgacgatcctattaacaggtgcgattgactgtatgttcaccttatccgtgtgtctgctgacctgtaattcagcgcgattattacgtgaggttctgccgcccgttttagcggtggcggatgaaattattgtcgtggattccgggagcagcgatgccaccctggatatatgtcatgaatatgaactggttattcaccaccacccttacactatgcatggcgcgcagatgaactatgccatcagtctggcgaccaatgactgggtgttatgtctggacagcgatgaagtgctggatcccgaaaccattgattttattttacgtctgaaagcgggagagacgcctccccctgaccaggcgtggcggctttcccgttactggtatgtgctgggggaagaagtgcgaaccctttatccggtgtcgtcccccgattttccggtgcgattattcaaccgtcagcatgcgcgttttaacgatcgaccggtggacgataaagtcgaaggctttagcacttcggtaaaaattcccggacgcgtgcgccacgataccttttattctttgcatgaagttttcaacaaactcaacagctatacctcgcggctggtgaaatatcagcaggtgaaaccgtcaatcgggcgcggcataataagcgccataggcgcgttttttaaatggtatctgtttagcggggcatggcgtagcgggaaagtcggggtggtaaccggtttatatgccacgctttatagttttctgaaatatttcaaagcctggtatattcatcaggatgaaaaggcggcgttgccgaaaacgcaaaaaaatcgccgcctgatctgatcatcagcccgcctgctggcgggctttgccccatccctgccactggccctgcacgtatttcaccagcggactctcgctgatgctttcgctcagcacgctaaagaaacgcgtcgcatcaacgcgctcaggggctgtcttcggtttacacaacttcacgccgcggaacgggttgcgcggtgcctgcggttggctggcgggcggcgtcagcacaggttttgaggtgtcgatctgcggctcgttcagcaggctgcccggacgcaccagcgtgatatccggcggcaaagtgggcagcatttgttgcaggacgcgcactgttgacgggtgcgggtggccgatggcgatcgccgagccgttacgccgcgccagttctaccgcgcggttaaactggcggcgaatatcggcttcgttctgggtatcgtcgaggaacactttacgcttgatcaccttcacgccggtgcccgtcgccgcgcgcattgcctggctgttgccgatggtcatactgtcgagaaaatagagatcgtaacgcgccagcgcctgcatcaccttctgcatgccgaacaggctggaggtcatggcgctgcccatatggttattcagcccgacggcatagggcacactgtctaccgcattgcggatgatgcgctcgatttcatcgctgctcatgtccgggcgcagggtgtctttttccagcggctgtttgctgagcggggccatcggcaggtgaatcagcacttcgtggcccagattatgcgctttggtcgccatttcccgcgcatgaggcgcattgggcagcacggcaacagagatggcggcaggcatcgccagcacctgattttcgttgtgcggacgataaccaaaatcatcgatcacgatggcgagttttccggcaaacgccggggcggtgaaaaccagaacgctgacaacagcaacaatcagacgacgaaattgaagcaaaacttatcttcccaaccacggttgtggattgaccgcctgaccctggcggcgaatttcgaaatagagtgaaggtctgccctgaccgccactgctgcccacaagggcaatcggttgaccggcacgcacctgcgtgcccacgctgaccagcgcgctctgattatagccgtaaagactcatgtcgcctttaccgtgttcaaccaccaccacaagaccatagccctgcagccagtcggcgaggatcacacggccatcggcaatggcttttacttcgctgccttcagaggcgccgatcacaattcctttccaccgtagctcaccctgtaactgttcgccataacgatgcaggatagtgccccgtgccggccagtaggcctggccgcgtggcgatccgaggccgccggtgcgggacatcagcgactgttcgctttccgtcggcttataggtggtgcctttgcgcgaggcgtctttctggcgatcgcgcaccgcctgggcttcgcgcgcttcacgttccgcccgcgctctggcggcggcttcggcgcgggcaagggtattgcgcagccgtgattcgttagcccgcagttcgctcagctgttgctggccctgctggatggacgactccaggcctgcgagggttttcttacgctcgttgcgcgcctgctcaagcttagcctgctgtgcctgctgctcataaagcagggtttgctgctggctctgcttctcttccagctcggctttctgagagttcacttcttcacgggtttgctggagctgggcgatggtttcctgacgcgcctgattcagatagccgtaataggcctgcagacgctgcgatcgctggccttcttcgccgctgaggatcatctgtatcccgctgtgttcgccctgacggaatgccgcatcaagctgcgcggccagattacgctcctggctggcgcgctggcgctccagtctggcgatagatgcattcatctcatcaatttgtttattgagctggccgagagtgttctgggtttcgcgcagagcgcgggtggcggcagagatcgcctcttcctgcgcttttaactgggcgaggagagtgctgcgctgctgctgttgcttacgaacggcacgttctttggcggcaatgtctgcctgaatggattttaactggtcgcggtcatccgcgtgggctgaaaaggcgcacaacaatacgccagcgctgagcgcgctggcgtagatcacggaccggatcgacacagtccaggtgtttgaaaaaatcgcctttcccctcatggggagcgattattccacgatgaacagcggcttaccagtcatctcttgcgggatttccatgcccatcagcgccagcatggtcggcgcgatgtcggaaagtttgccgccatccaccgctttcacggttttgtcgcccacatagatcagcggcaccggcaggttagtgtgggcagtatgcgcctggccggtggccgggtcgcgcatctgctcagcattgccgtgatccgcggtaatcagcagctggccgcccacggactccaccgcctcgctgacctgcgcgatgcagttatccagggtttcgacagcggcaaccgccgcttcaaagacgccggtatgtcctaccatatcgccgttcgggtagttgcagatgatggcgtcatacttgccgctgttgatcgctgcgaccagtttttcagttaattctgcactgctcatttccggctgcaggtcgtaagtcgccacttttggggagttgatcagaatgcgatcttcgccggcaaacgactcttcaacgccgccgttaaagaagaaggtcacatgggcgtatttctcggtttcggaaatgcgcagctgggttttgtcatgcttcgccatccactcgccgaaggtattcgccagggacgccggtgcgtaagccaccgtcgttttgatatcggcggcgtattcggtcagcatgacgaaatcgcttaactgcaccactttctgacgggcgaagccgtcaaaatcggcattcacaaaggcgcgggtaatttcgcgggcgcggtcggcacggaagttcatgaaaatcagcgcatcgccgtcgaccatcgcggagtcggcctggccttcggcgcggatcaccgtcgcttttacgaattcgtcgttttcatcacgggcataggctgcctgtaaacctgcgaccgcgctgtcggcctggaactcgcctttcgcctgcgtcagcaggttgtatgcctgttccacgcgatcccagcggttatcgcggtccatcgcatagtagcgaccaataatagtggcgacgcggcctttgcccagttcagcaaatttgtcttcgaagcgtttcagggacgattctgcgctgcgtggcggggtatcgcggccatccaggaaagcatgcagatagattttttctgcgccgcgctgagctgccagttcgaccatcgcaagaatgtgatcttcatggctgtgcacgccgcccgcagacagcaagcccatgatgtgcacggctttgccgctggtggtggcgttatccaccgcagcggtcagcgccgggttgctgaaaaaggtgccctgtttgatttctacgtccagacgggtcagatcctgataaacgatacggcccgcgcccagattgacgtgaccgacttccgagttgcccatctggcggtccggcagacccacttccaggccggatgcgtcaatcagcgtatgcggacgtttcgcccacagggcatccatgaccggcgttttagcgttaaaaatagcgttatcctgctggtcttcacgatagccatagccatcgaggatcaccagtaccataggttttttagaaaccgacattgcgacaacctcatgctcatgagtcaaaaatttgcgtaattttactacagctgaatcgatcaaatagccgcagaagatcaaagaatgaggtggggaagggctgtgtttttaatggcttcaggcatttttttcgtaacgcgccgcagaaaatgcattccgttgtgctcgctggctgtatttgctacaccgcacaggtatactcctttcctggtttttaatcattgagtcgggagttgttgccctccatgcaagaaattatgcaatttgttagccgtcaccccatactttgtatcgcatgggttgtcttactggcggcggtgctgttcaccaccttcaagggtctggtgtcgaaagttaaagtcatcacgcgtggtgaagcaacgcgtctgatcaacaaagaagatgcggtggttgtggatctgcgccagcgtgatgatttccgcaaaggccacatcgcgggcgcgcacaacgtgctgcctaacgatatcaaaaacaataacctcggcgagcttgagaaaaataaaagcaaacccattattgtggtagatggtgccggtatgcaggcccaggctccggcgaacgagctgattaaagcgggcttcgaacgagtctatgtactgaaagatggcgtagctggctggagtggtgaaaacctcccgcttgttcgcggtaaataaatcataagtggagtgctgtcatggccaacattgaaatctataccaaagcgatctgcccgttttgccatcgcgcaaaagcattgctcaacagcaaaggcgttgccttcgaagagctgccgattgatggcgatgcggtgaagcgcgaagagatgattcaacgtagtggccgtacgaccgtgccgcagatttttattgatgcacagcacattggcggctgtgacgacttgtatgcgctggacgcgcgtggtggactcgatcccctgttacgctagagcgtatttaggacaacactaaggactactcatgtcagaacaaaataacaccgaaatggctttccagatccagcgtatttataccaaggatgtgtctttcgaagcgccaaacgcgccgcacgttttccagaaagactggcagccggaagtgaaactggatctggatacagcttccagccagctcgctgaagacgtttatgaagtggtgctgcgcgtcaccgtgaccgcaagcctgggcgaagaaacggccttcctgtgcgaagtccagcaggctggtatcttctccgttggcggtatcgaaggtacccagatggcgcattgcttaggcgcatactgcccgaacattctgttcccgtatgcccgtgaatgcatcaccagcctggtttcccgcggtacattcccgcagctgaaccttgcaccggtcaacttcgatgcgctgttcatgaactatttgcagcagcaggcaggcgaaggtaccgaacaacctcaggatgcctgatgagtacgataaatgctcatatgactgtgatcggtgccggctcttacggcaccgctcttgccattaccctggcaagaaatggccacgaagtggtgctttggggccacgatccaaaacatatcgcgacactgcaacacgaccgttgcaatgtggcgttcctcccggatgtgcctttccccgatacgctgcaccttgagagcgacttagcgacggcgcttgccgcgagccgcaatattctggtggtggtgccaagccatgtttttggtgacgtgctgcgacaaatcaaaccattgatgcgcgacgacgcgcgcgtggtatgggcgaccaaaggcttagaagctgaaacgggccgtctgttgcaggatgtggcgcgtgaagcgctgggcgatgccattccgctggcggtaatttccgggccgaccttcgccaaagaactggcggcgggcctgccgacggccatttcacttgcctccaccgacgaggttttcgctgaagatttgcagcagttgctgcactgcggcaaaagcttccgtgtctacagcaacccggattttatcggcgtgcagctgggcggcgcggtgaaaaacgtcattgctattggcgcgggcatgtccgatggcatcggttttggcgcgaatgcgcgtacggcgctgatcacccgtggtctgacggaaatgtcccgtctgggcgcggcgctgggcgccgatccgtccacctttatgggcatggcgggactgggcgatctggtcttaacctgcaccgacaaccagtcccgtaaccgtcgtttcgggatggcgttaggtcagggcatggacgtaaaaagcgcgcaggagagcatcgggcaggtcgtggaaggttaccgcaataccaaagaagtccgcgagctggcacaccgctttggtgtcgaaatgccaataaccgaggaaatttatcaggtattgtattgcggaaaaaatgcgcgcgaggcagcattgaccttattaggccgctcccgcaaggatgagcgtaccagccatccggctccctaatcctcatcactgacacggccatcgcagagtggccggtcattttatttcgcctggagtatgcaatgccgtgtgaagaactggatctcgtctggaataatattaaagccgaagcccgggcgctggccgattgtgagccaatgctggccagtttttatcacgcaaccttactcaagcacgaaaacctcggcagcgcgctgagctatatgctggcgaacaaactcgcgtcgccaatcatgcccgccatcgccattcgtgaagtggtggaagaagcctacgctgccgacccggaaatgatcgcctccgccgcctgcgatattcaggcggtgcgcacccgcgatccggcggtggataaatactccacgccgctgctctacctgaaaggttttcacgccctgcagtcttaccgcatcggtcactggctgtggaatcagggccgccgcgcgctggcgattttcctgcaaaatcaggtgtcggtgtccttccaggtagatattcacccggcggcgaagattggccgcggtatcatgctcgaccatgccaccggcattgtggtgggggaaacggcagtggtggaagacgacgtttcgattttgcagtcggtcacgctcggcgggaccggcaaaaccagcggcgatcgccatccgaagatccgtgaaggcgtaatgattggcgccggggctaaagttctcggcaatatcgaagtcgggcgcggcgcgaagattggcgcgggttcggtggtgctgcaaccggtgccgccgcacaccacagtggcgggcgtaccggcccgcattgtcggcaagccggagtcagacaaacccgcgatggatatggatcagcattttaacggcgcgaatcaccgcttcgagtacggcgacggtatttaacgctagctgcgcagtaccgcgcccggatagccaagctgacgccaggcctcgtacaccacgaccgacacggcattagacaggttcatgctgcggctgtccggcatcatcgggatgcggatcttctgctctttgggcagcgcgtccagaatggcggcaggcagaccgcgtgtctccggaccaaacatcagataatccccgtcctgataactcaccgcgctgtgggctggcgtgcctttggtggtcaaagcaaacagccgctgcggattttccgctgccacaaaagcggcgtagtcagcgtgacgcaccaccgcggtaaattcatgataatccagcccggcgcggcgcagacgcttatcatcccaggtaaaacccataggttcgataatatgcaggcgaaaaccggtgttggcgcacaggcggataatgttcccggtgttcggcgggatttcaggttcgaataaaacaatgttcagcatgctgccccctcaataatggcgggcagcatagcaaaaatcaggcggcatcgcctgttttcaccggcgcaaacaccgattcatgctcaacgttctgcaccagcgagtcgcggctgatttcgctgatagaacgcgccccggttagcgtcatcgccacgcgcatctctttttcgatcaggttaagcaggttcgccacgcccgcctggccgtgggtcgccagcgcatacagataggcacggcccagcagcacggtatccgcgcccagggcgatcatccgtacgacgtccagcccgttacggatgccactgtctgcgaggatcgcgatgtcacctttcaccgcatcggcaatggcgggcagcgcgcgggcggaagagagcacgccgtccagctggcggccgccgtggttcgataccacaatgccgtctgcgccaaagcgcaccgcatcgcgcgcatcttctgcatcgaggatccctttgatcaccatcgggccgtcccagtattcgcggatccactccaggtctttccaggaaatcgatggatcgaagttattcgccagccagccaatataatcttccagcccggtcggcttgccgaggtaggtggagatgttgcccagatcgtgaggacggccattgacgccgacatcccacgcccactgaggatgcgttaccgcctgccagtaacggcgcatcgccgcgttggcgccgctcatgccggaatgggcgtcccggtaacgcgcgcctggcgtcggcatatccacggtaaacaccagcgttgaacatcctgccgctttggcgcgctccagcgcgttacgcataaagccgcgatcgcgcagcacgtacaactggaaccacatcggacgcttaatcgtcggagcgacctcttcaatcgggcagacggataccgtcgacagggtgaaagggatgcctttcgcatcggcagccgctgccgcctgcacttcgccgcgccgcgcgtacatgccgcacagcccgaccggagccagcgccaccggcatcgacagtttttcattaaacagcgtggtttccagactcaaatcggacatgtttttcagaacgcgctggcgcagcgcgacctgcgagagatcttccacgttacggcgcagcgtatattccgcgtacgcgccgccgtcgatgtaatggaaaagaaagggtggcaggatgcgctgcgcggtggcgcggtaatcactggcggcggaaataatcatgggtttctccctgacagtttattgggttaaccgggcaggcgggtgatgcgcgcctggcgggcctgatcttcatcgaatcgtttaatggtggtatgcacaaattccagatgcagcatcatcgctttacgcgcgccgtcggcgtcaccggccataatcgcgttcatcaccgcctgatgctgttcggtgagctgcgcgaacaccggcggcacgaaatacatccgctggcggctctgtttcactgacagttgcagcagatcgaaaaagccgcgcatggtctgcaacagcaccacattgtgcgacgcttcagcgatggctaagtgaaagcgcacatccgcctgcgaagcgagatccgggtcatcgctcagggtggcgtcaaagcagagctgaattttttctttatccgcagcggtggcgcgcagggcggcgtgccaggcggtactggcttcaatggcatggcgggcttccagaatatcgaagctgtagtccggatcgtctgccatcagggttttcagcggataaacaatattttgctctgtccagtcttcctgcggccagcgcacaaaggtgccgccgccgcgtcggctgagcagcacgccttcgctgatcaacttcgcaatcgcctcccgcagagaattgcgggagacgccaagctgggcggccagcttgcgctcggcgggcaaacgcgcccccggctcaagctgctgttcgtctatcagcgcacgcaagcgatcggcgatggtgtcggacagacgcacgggcatcactatcatgggatcatccaggtcagaacgtatgcctgaagtgtagtgatcactcccaccatgcaggtgaaaatcaggctgtgtttaacggtaaagcggaacagatcggactctttacccaccagccccaccgccgcgcaggcgatggcgatagactgcggcgagatcatcttgccggtcacgccgccggtggtattcgccgccaccagcagcacatccgagacgccaatttgctgggcggcggtcgcctgcagggcggcaaagagcgcgttcgaggaggtgtcggagccggtcaggaatacccccagccagccgaggaacggcgagaaaaaggtaaacgcatgaccggtatgggaaagcgccagcgccagcgtcgaggacagcccggaataattagagataaaggcgaacgccagcaccatgccaatggagtagatcggcagcgccagctctttcagcgtgctgccgaaggtgtagagcgcctctttcggcttcatacgcagccagacgatggagatcagcgccgcgaacagaatggccgtgccggtggcggagaaccagtcgaacttatataccgccgcataaggcgtggccgcgctcactaccggcggcatacgcgccaccagcttatccagatacggcacggagatattaatcacccagtcgtacatcgcgccgccaggggcaaacagcgctttaaacggcggaatgctccacagggtgacggtggcggtcagaaacaggaacggcgaccaggcgcgtatgatttgcccgcgggagtaggatttcggcgtaacggcggcatcattcgcagtggcattcacatcttcaaagcggaagatgcgcaccggctgccagcggcgcaggaacagcgtcaggcacaccagcgaaaccagcgaggagataatgtccggcagttccggcccgagaaagttagagctgaggtactgggcgatggcaaaggagccgcccgccacgatcaccgcaggccaggtttccttcacgccgcgccagccgtccataatcgccatgatccagaacagcacgatgatggtcaggaacggcagctgacggcccaccatctggccgatttcaaagctgtcgaggccggttacctggcctgccacgagaatgggaatacccatcgcgccaaacgccaccggcgcggtgttgacgatcaggcatagcccggcggcatacagtggtttaaagcccagccccaccagcagcgcagcggtaatggcgaccggcgcgccaaagcccgcggccccttccagaaaggccccgaacgagaagccgacgatcagcatttgcaggcgctggtccggcgtaatggagagaatggacgagcgaatgatctcaaactggccggttttgaccgagattttatagacaaagaccgccgcgacgatgatccacgcaatcggccacaggccatagaagaagccgtacaccaccgaggcgagggcgttatccaccggcatatcgtagaagaacagggcaacggccagcgcgatggcaaccgtccagctggcggcgacgtagcctttcagcttgagcttaattaaggcgaagaagaaaaacaggatcggtaacgaggcgataaggctcgacagccacagattccctgccggatcgtaattttgttgccagaggctcatgaagatctcctgagggccatttatcctgtcgcgcggcgagtctgcgctcgtctgcacgtcacactgtctgtaaaagtggccctgccagttaaggtttgtagggttaatgacaatgaatggttaactaaatgttattgactggcaatgcatgtgtgacaggaaatgatatatctgtgagcagaacaggactcaggggcaggattggtaggaccacatcagaagggaagcgcagataaaaacctctcccgcggacggggagaggtcagaaagcaggggatcagaattcggttttcgaaaagccggtcatctcggtcagcttcatttcgcgacctaattcggtcatcggatgcaccaccaccaggccgcgcacgcttttcttcagcttgcccatgtcggcctgttcttttttggtgatggcgcggcggaacggcatatccgccagtttctgcgcttctttgctcagcttatgcccgtgcagggcgcgcaaacgggcgatttcgccttccagcgtctctttttctttttccagctcggcgtatttgtcggcggcttcggccagcgaaatatcggcctgctggtggcggatagcgtcaaggcgatcgctcaggcgtttaatttcactcttttcaacttctttcatgacaattggactctgaatcggggagatattgcgctaaggatacactaaaccgcgggcggttacttctgaaaggcttttttcaggctgatgcgggagatcagctctgtcagggaaagcaccatggtggaacgtacaacctgttgataacgctgcttttgcatggcatagagatcggcatcgctgagatcaaactgcggcgcggggggcagggcggcgacgcagtgcagctcaccgaaggggcccaagatctcgtcgtcggtgaaagcgtattcgttgccgtcgtgattcagctcttcccgcagcgccatcagcagctcggcgtcctcgtattccggacggctgatgacgccaagcccgtaaatcagttttaagcgcaccgacaaatcgcccagcgggccgttgccgtccagcagcggctcaacggcatatttcaccgcgtaatcgtctttgcgaaaaacctgaagcaccagaatgttcaccgcctcggtcagtagctcgacggcggcgatcaaaaagctgcgtacggttttgcctgcattaagacgctcaagcacacggttttcaaaggcctgggtttcttccattattgcctgcatatccgacaatctgttgttcgggcgcggaaagctccgcgccgggtttggcatcatgcctttgcgttgtacgcgttaacggcctcggtcacgacgtcgctcgccgcgtccagcccggaaatctgcgccagagccgcctgcgggcctttctcttcaatcaactgcgccagctcaatggcctgcggatcctgctcgctgcgatagtgcatcgcggcggcaatacccagcaccaggttgtgatgcggcaggtcgtattccagcgtgcccagcagcggcttgatcaggcgatcgcccgcgctcagtttacgcagcggctgacggccaacgcgctccacatcatctttcagataggggttttcgaaacgacccaaaattttctggatataggcggcgtgtttctgcgtttcaaagccataacgtttgatcagcaccgcgccgctttccaccatcgcaccttttaccacagtacggattttctcgtcgagaatggcatcacggatagtctgcaaaccggcctgctggccgagataggcggtaatggcgtggccggtattcagggtgaagagcttacgctccacgaaggccatcaggttatcggtcagctccatgcccggaatattcggcagcgtgcctttgaactgggtctggtcgacgatccattcgctgaaggtttccacggtgacttccagcggatcgttggtagcggaggccgacggcggcacgatacggtctacagcggagtccacaaagccggtatgcgcttccacccaggctttatcctcttccgccagcgcgttgaacacgtggcctttcagctgcgtggtgccgcgcaccatgttttcacaggcgatgatattcagcggcgtgtcgttaccctgggctttacgttttgccagacctttggcgatggcaggagcaatgcgctccagcaccaccgggccaaccgccgtggtcaccagatccacctgcgcgatgagatcgatgacttcatcgccagtgctgttgaccgcgttaacgccggaaacggtgtccacctgctcattttcaccaacaacgtgaacctgatagctatgacgggcattcagggcatcgagcacggcctgattcacatcggcgaatgtcagctcaatacccgcgtccgccagcaatttgccgatgaaaccacgtccgatattacctgcgccaaaatgtaatgctttcatagaattaccttcatcaatgtttttacccgagagggctggggtgaggaggcgaattcccctcaccctaaccctctcccaatgggagaggggaaagggcgtaaccttacttgttcagcagggccagcacttcttcaacgctctgcgtgtgtgtcaggcgctcaatcacagattcgtcgtccagcgcgttagtcaggctggtgatcacctggatgtgctcgttgttacgggcggcgataccgataaccagacgggcaatgtcgtcggcatcatcaccgaagcgtacgccttccggatactgacagaataccacgccggtcttcagaacacggtctttcgcttcaaccgtaccgtgcggcacggcgatggactcacccagataggtcggggtcaatttttcgcgatccagcatcgcctgcacatactccggctcaacgtaaccgcctttcaccagctgctcaccggcaaaaataatggcttcttctttggtgctcgccgtgcggcccaggaagatgttttctgcgccgaggcggaacaggtggctgttactttcgtcgaagctgtcctgcaggctggtgcgcactttctcttcattttgctcgtggcgctgtgcggcaaccagacgttcagtcaggctggtgtacaggccgctgtcgaggaagttggtcagcgaaatatgctgcgcctgcggcacctggcgcatcgcacgctcggtcaggtcgcggtgcgtgatcaccaggtcaacatcgcccggcaggttgttgatcgcgctgttggtcacggagatgttagtcagccccgcatcctgcactttcttacgcagcacgcctgcgcccatggcgctggagcccataccggcatcacaggcgacgatgattttacgcacatggctcaggtcgttggacacttcgcccgcggtcagcggagaggcgcctttggactcggctttcatgtcctgcatgcgacgggttgcggcttcaatatcgtcgtcttctttcactttgctggttttcagcagaatggcggagatgacgaaagaaacggccagcgcagcgaaaatcgcggcgaggttagcaaaataggcacccttcggggtcatcgccagtaccgccaggatagaacccggagacgccggagacaccagaccaccgcccagcacgctcagcgtaaacacgccagtcataccgccgaggatcaccgcgatcagcagacgcggattcatcaggacatacgggaagtaaatttcgtggataccacccaggaagtggatgattgccgcgccgcccgcagactgtttcgcgctgccgcgaccaaagaacatatacgccagcagtacacccatacccggacccgggtttgcttcaatcaggaagaagatggacttgccgagatcgtgagattgctgaatacccagcggcgagaagataccgtggttgatggcgttgttgaggaacaggattttcgccggttcaacaaagatggacgccagcggcagcatgtcatggacgaccatgaagttaacgcccgcagccagtgctttagacagcacttcaaccgccgggccaatgccgaggaaggcaagaatggcgaggatcataccgatgatgccggcggagaagttattcaccagcatttcgaaaccggatttgatcttaccatctaccgcggcatcaaatttcttgatgcacagaccgcccagcggaccggcaatcatagcgccgaggaacatcggcatatctgcgcccacgataacgcccatggtggtgatagcaccgaccacgccgccacgctcaccgccaaccagacgaccaccggtataaccgatcagcagcggcagcagataagtaatcatcgggccgacgagtttcgccagcgtttcgttaggtaaccatcctgtcggaataaagagtgcagtaataataccccaggcgataaacgcgccgatgttgggcattaccatattgctaaggaatcgaccaaagctttgcaccttgatcttgatatcggatgacataaaacaccccttcttatgtttgctagcgcacaggccggaagcccgaggtttgttgttaatgtggcggcagaggtagccggacccatgatgtgtgtgaggcgaaatctggcaccgaatcgcctttctgtccagacagcgccctttggtgtgatctgaatcacataaacatagggtgtatccggggataaggcgtgatcaacttcacaaaacactggtgtaaaaaaagaacaccgccgaaaaaatcgacgcagaatggctgttaatgtgatgttaatcacatttgtatttcatgactttgttatttatttgtgatcttaatcacaagatatttttgtcaggagttttctgactgtgatcaaaggcaaactgtgatgtagacgcagacggcagatgtaacttccttacactgccgacaccttacggaacagacttttcacatttatgaaggcgcccctgccttttgcgcggcggtgggccataattatctcttcacaggcgattaaggacccggccatgaaactgattggcagctacaccagccccttcgtgcggaagatttccgtgatcttgctggaaaaaggcatcaccttcgaattcgtcaacgaaatgccctataacgcagagaatggcgtttcgcaatttaacccgcttggtaaagtgcccgcgctggtgactgacgacggtgaaacctggtttgattcccccattattgcggaatatctggaacagctgggtatggcgcctgcattgctgcccagcgatgcgaaagcggcattacgggtgcggcagctggaagcgctggcggacggcattatggatgcggcgctgacctccgtgcgcgagcaggcccgtccggcagcacagcagtcggaaagcgaactggtgcgccagcgggaaaaaatcagccgcgcgctggatgccctggaacaatacgccgccaacggcgtgttgcagtcgcagtccctcgatctggcgaacatcgctgtcgcctgcgcgattggttatctgaacttccgccgcgtgtcgccgggctggtgcgtggagcgcccgcagctggtgaagctggtggaaacgctcttccagcgcgaaagctttgcccgcaccgaaccgccaaaggcttgatacgcattatgacagcctgagcaaagacgctgtacaatcccctcacgtcgaccccttcccgacggaggggccaatcacagcaaggcagtgtcatgacccctgaaaatcgttccctgttcagccagatcccggcaaccgaccgtttattgcgtgatgatgccttccgcccgctgttagccacttttggccatacgcgggtggtggaggcgctgcgcctgttgcagaacgaggcccgcgccgccattcacgacagccagacgctgccggactggagcgctgactgggccggggccacacgtcagcatcttcaccatcagcagcagagcgctatccgtccggtgatcaacctgaccggcaccgtgctgcacaccaatctcgggcgggcattacaggcggaagcggcgatcgaggcggtggcacaggcgatgcgttctccggtgtcgctggagtacgatctggatggtgccgggcgcggacatcgtgacagcgcgctggccgccatgctgtgccgtctgacgggggcggaagacgcctgtatcgtcaataacaacgcggcggcggtactgttaatgctggcggctacggccagcggccaggaagtggtggtgtcgcgcggcgagctggtggagattggcggcgcgtttcgcattccggacgtcatgcgtcaggcgggctgcgagctgcatgaagtcggcaccactaaccgcacccatgcgaaagactatcgtcaggccatcaacgacaatactgcgctgctgatgaaagtgcataccagtaattatcagatcgaaggctttacgaaagccgtggacgaagcggaactggtagccattggcaacgagcgggacgtgccggtggtggtggatttaggcagcggctcgctggtggatctcagccagtacgggctgccgaaagaacctatgccgcaggcgctgatcgccgcgggcgtcagcctggtcagtttctccggcgataaactgctcggcggcccgcaggccgggatcatcgtcggcaaaaaagcgctgattgcccgtctgcaacagcacccgttaaaacgcgcgctgcgggcagacaagatgaccctcgccgcgctggaggccacgctgcgcctctatctgcatccggaaaaactcacgcaggatttgccgacgctgcgattgctgacccgcgataccgcgacgatccgcgccctggcggaaaaacttcagccggtacttgccgcgcattttgctgatttccacgtacagattgaagcctgcctgtcgcagattggcagcggttccctgccggtggatcggctgccgagcgtggccctgaccttcaccccgcaggacgggcgcggcagcaggcttgaaaccctggcggcgcaatggcgcactggtgaagtgccggtgattggccgcatcaccgatggccgcctgtggcttgatttacgctgccttgaggacgaaacccgttttctggagatgttactgaaatgattattgccaccgccggacatgtggatcacggcaaaacgacgctgctggaagcgatcaccggcgtgaacgccgaccgcctgccggaagagaaaaagcgcggcatgaccatcgatctgggttatgcctactggccgcaggctgatggccgcgtaccaggatttattgatgtgccgggccatgaaaagtttctcgccaatatgctggcaggcgtcggcggtatcgatcacgcgctgctggtggtggcctgtgatgatggcgtgatggcgcagacccgcgaacatctggcgattttgcagctgaccggccagacgacgctgaccgtcgcgctgaccaaagccgaccgggtggacgaggcgcgcattgccgcagtacaggacgaggtgcgcgacacgttgcgggagtacggctttacgagcgcggcgatattcattaccgccgccatcgcacagcgcggcatcgatgaactgcgcgagcatctgttacgcctgccggagcgggagcacgtgcagcatcagcgtttccggctggcgattgaccgggcctttaacgtgaagggcgcgggcctggtggtgaccggcacggcgctgtctggcgaggtgcgcaccggcgataccctgtggctgaccggcattaacaaacccatgcgcgtgcgcggtctgcatgcgcaaaaccagccggtcgatcatgcgatggccgggcagcgtatcgcgctgaatattagcggcgacgccgaaaagggatccataacccgcggcgactggctgctcagcgaggcgccgtcggagccgtcttcccgcgttatcgtggcgctgcaaagccatacgccgctgacacagtggcagcccttacacattcaccatgccgccagccatatcaccgggcgcgtctcgctgctgaccgacgatctggccgagctggtgctcgacagtccgctgtggctggcggacaacgatcggctggtgctgcgtgatatctcggcgcgcaccacgctggctggcgcgcgggtggtgatgctcgatccgccccgccgtggcaaacgtaaaacggcgtatctggactggctcgctactcttgccgccgcgcaggacgatgccagcgcgctggcggcgcacctgatccgcggtgccgtctccctgagccgcttcggctgggcgcggcagttaagccgcagtggaattgacgccttaacccgcaatgacgggctgatccagtcgggggacagcgtactgagcgcgacggtggccgcaggctggcagcgcaaactgctcgataccctggcaacctatcacgaacagcataaagacgaacccggccccggacgcgagcgtctgcggcgcatggcgctgccgatggaagacgacgcgctggtgatgacgttaatcgagcggatgcgggaaaacggcgacattgccagccatcacggctggctgcatctgccggaacacaaagccggttttaccgaagagcaggcggcgatctggcagcgtgcggcaccgctgtttgcggatgagccatggtgggtacgcgatctggcgcgggagacgggcacggatgagcagatgatgcggggtgtactgcgacaggcggcgcagcagggactgataacggcgatcgtcaaagatcgctattaccgtaacgatcggatcgtcgcctttgccagtatgatccgcgaactggatcaggcgcggggatcaacctgcgcggcagatttccgcgatcggctgaacgtcgggcgtaagctggcgatccagatcctcgaatattttgaccgcatcggctttacccgccgacgcggcaacgaccatctgctgcgggatgcacagctgttcccggaaaatagctgaatccagccgggtttttacccggctttaacctgctgttttgtcagccataccgcgccgagcctgcccgcctggttacccagcttgcacggcaggatgggcgctttcagaaattcccacatctcgaaggtttccagatggcgatcgagcagttgataaactttctcctgctcgcttaacccgccgccaatcagcacgacctgcggatcgtacatggaaatcacgctgtaaatgccacgcgacagaaagcgcgcccactggttaacggcttcgcgcaggtgcacgtcactgtccatacgttcgaaaatctctttgccgtgaggcatctcttcggcggagagtgccagcgcacggcggcaggcttccatcaggccacgggcggaagccacttcatgcatgcattcgccgtcgttaccgaccggcatcacgccaaactcaccggcacggaaatgcgatccgcgatacagttcgccgtcaaaaataatgccgccgccgataccggtgccgacggtgatacagacgacgttgtcgtaatcctgcgctgcacccagccagcgctcgcccagcgcggcacagttggcatcgttctcgacaatgactggcagatcgctgagttccgcaaacaactcgcgcaggttaatgccgtccataaagtccagcgctccggctttcatggcaacgccggtacggatgttgatgtatccggggaaactgatgccaacggcgacgatgtcgtgctccttttgatagccctcaaccaccgcctgccatttctgcttaaacgtctcaacgtcttccggcgtgtcgtactcgtccgaggtcagttcctcgccattctcatcaatcacgccgtgcttgatgtgtgtaccacccacgtcaaaaccaataaaatactgcatagtttttttcctgtgataaccgctcaggctaagtatggttcaggcaggccagcgcaacgtaaagtaaggtaataaacaccttcacttattcttaaattatgacggggtggcaggatagattaatccagtacagcgattctcagcggcctgaagcggctgtagatccaaagcccaaggcagctcagtgagccaagaatggccgtcatgatcgcactcataagaatgccgataagcagcccgaccggcagtgcaagcaaaccatgaatatactgctggttccagctcacggtgtcgtagccaaagcaggcgaataagccaaagataaagcccagtacggccatgggaatactcaggccgataagcagtaaacgataaatgctgcgggccttaatacgtttcatgtcggtcaccgcgcggttttcagtatccatacaacatcctgttgagtttaatgaattactattatgggctgaattcccgcgcggatctaatatgccgttactcttcattcacccagatacgcatctctccttcgcctcgattcgcccaactgaaccagggaataaacgtcagcttctgaggggtacgtctgacgggagaagtatcgtaatgccacagcggttgctgctcggcctgtgcggcggtacgtttataaccatccgcctgaatcagcactttatgcgcaaaaattcccttaccgtccagcgtagtaaagacgctgtcctccggcagccagagattatgcagctcttcgccgttatcggcctgttccagacaatacaccagcggtccgcgctgtacggcgactttaccagcctgatggcgcaccagcgggttgccatacacccgacgcacgggcattggcagcgtcagggaaagcgtatcgccttcctgccagacacggcgaagatgcagataacctttgcggatctcacccatggccgggtcgccattcagcgtaattgtcgggttggggcaccagtccggcaggcgcagggccaggatatgttccaccggctccggcgactcgatacgcagggtaagattttcctgccacgggtaattgccgctcagctgtaagcgcaacgttcgctccccaaccggaatctctgcccggttgccaatgtataaattaataaacagggtatctgcctgtggggtataaatgtaatggccgatggaggtcagcagacgggcgatattcggcggacagcaggcgcagccaaaccaccgctggcgcaccggctgtatgtggtcataaatatgattaaatggcagcgaacggggctgcacttccagtggattaacgtaaaagaagtgtttgccgtccagtgccatcccgccgagcaccgtgttgtatagtgcgcgctccatgacgtcggcataatggctgtcgccttccatttccagcatccgccgggcaaacatcatcaggccaatggaggcgcagctttctgcatacaccgtatcgttcggcagatcgtaatcgtgactgaacgcttcaccacggctctgcgagccgatgccgccggtaatatagagctgacggcgtgccatgttttgccacaaccgcagacaatcctgacgtttttgctcatctccggccagacgcgccagatgcgccacgccagtcatcagatagacaaaacgtaccgcatgaccgatggcactgtcctgttctgaaagcggtacgtgcgcctgactataggccttgtctttcaccatccatgcggtgccatgattcggccagtgccaggtgccgccacgcttttcaaactcagtatcatagaaatgcggctgagtgccgcgctgttcaacgaagtaggccacgagatcgcgataacgcgtctcgccggtgacttcatacaggcgcatcagggccagttcgatttccggatgcccatcatagccctgcagctggtccacgcccgggccaaatacacgatcaatgtgatcggcaagacggcagcccacgtcgagcagagcacgtttcccggtggcctgaaaataagctaccgccgcttcgatcatatggccagcagtgtacaattcatggcattccgcaagattcgtccagcgctcgccgggcgcttttaccgtgtaccaggtattgagataaccgtcttcacactgtgcggcggcaatcagcgcaatgacgtcatcggcagtcttttccagttcggggtcgggcttctggcacagggaccaggcgacggcttcgagccatttcgccacatcgctgtcctgaaaaaccatgccgtaaaattctccctcctgcagatcagcggcgatgcggaaattagcaatcgcatggctgggatcggcatccggaatacgatcattcagtgcatcccactggtaagggatcaccacatcgcgtaccagacgctgatactcgcctaaaaacggatcggtgaccttgagcgtgtgcaggtcggtttccattactttcattatcttctcctcaggactgaacatggcgctgacgcaaatcggtggcaatacgcgacatcatcgggttattaagtttgcaggcacgaatagtgacggccagcagcaggtggaaaagggcgggcaacagcgtttccatcgccgtaatgccctgtagcgaggcgggagtttgattgcctgcgccgggctggtaggcgacgacgataaaaagcaggctgatgatcccggcgctggatgcccaggcgagcttgataaaaaacaggttgaaggcaaagttcatgccggaagaacggacgccggttttccattcaccgtagtcatcggaaaaggccatcagcgaaaagtgcagcggcagcgtgaagccgaggatcacgccgttaccaagaatgaccgccagccatagggtctgatacgccgggccgcccggtaaaaaccacatcccgacagccagcgcggccaggaccagattggtgtagtaatacagttttacggcatcaatacgtcgggtcagggggttaacaatcaccgagcctaaaatcgaggcgaaagtcaccatggtaaaaaacagcgaggtataagccgtactgccctccagcacgtaggtgatgaaatacatgtagccgccgccgcgaatattgaacacgttgatcagcaggaatgacatcaccagcatcagtaacagctgatcgtttttacgcagcccggcaaggtgttcgcgcagggtaaatttacccatcagcgccagcggcacgcgttcacggacccagaaaaagcaacataaaaacatcaccacggcgagcgtgcacagcacgccaacgcccagctgataaccccgggcggcgtcgcccttgcccagcacgtcaaccatccacggcagtccgaccgagaccagaaatcccgccacgccgcacagtacgaagcgccaggactggcacgaaatcacctcattgtgccgggttgtcatggtattgatcagcgcacaatagggaacgttaatcgccgtgtagcccacggagagcagcagataggtgccaaacgcccaggcaatttttacgcccatgctggcatccggtacggtgaaggtcaggaaaccaataatgccaatcggtatggccacccacagctgccagggacgaaatcgtccccaacgactttgcgtacgatcggcaataatgcccatcaccggatcggaaatagcatcaaagacgcgtaaggcgataaacagcgtgccgaccaacgccggtgttagtccaaaaatatcggtataaaagaaggtaagaaaattcattatcaggcaggtaataaccgtgccgccggcatcgcccaggccgtaacctattttttcgcgtaccgataatagggcgtcgtgattagaatgggcgatatctgtttcagacagagatgtagaggtcatcgataactcctcgcagcgtggagaggccgtttttacgttgcccgtgaaacaccacaggccgttattatgggttatgaccttattaattctgcccggattattaccgccaacaaggcaacaaagaagtataaaaagatgacgatcccgacctcatcggaaaagtgtgaagccgatcgagctggtggggaataattcattaataatcaatttataagcctttaattattggcgataagaacaggaaattgaatattcatgcttaatttatccataatacatccgattaaagtgcaaaatggcggtttatttatttcacgcggtatggggcgtcatccggctcgtaaactgaattcatgggaagtgattttcgtcgaaaaggggatgttgacgatcgaggaagaagggcagctatttaaggtcagcgccggggaaagtctattattatggccacagcggcgtcacgtaggcgtggaggattttcccgccgatcttaaattctactggctgcattttgaagtgcaggaaagcagcctgcctgttgagtcgacgctaacgcttaccgtaccgcagcatactacgccagaggatccgcaatatgttatttccttgttccgccagtttctgagcgaacaggaaaaattaacgcgcagtgccgctctggaacttattttattactgatcctgcaacaaattaccctgaccggaagtgccgaaacgcagcaagacgatcggggagtgtcttttgcctggaaagcgcagcagcttattcgtacgcagtatcatctgcccgtttccaccgccacgctcgcgcgggaattacactgcaatgccgattacctcgggcgcgtttaccggcgtacgtttcacctcacgctgacggaagcgatccaccgccagcgggtgcggacggcagaaaagtttttactcagcgatgcgtgttcgctgaaagagattgccacgctgtgcggcttcagcgatgtcggctatttcagaaaaattttccgtaagcacaccggcttaacacccgccgtctggaaacggcgctactgcaaggaacatataaattcatgaaattattatcggtttacagaaaattcagtcaatccattaacgtaagttattaaaattccacgtcacggtgaggttatagcgccagtcgcgacggcggttgtcggtgggcacatcgcccgtgggacgggctgcttccaccgccagcgtatagtgtttgttatcgccgaccatcacgcccgccgccaccgagcttaaccgctgctggcgaaagccggacgcgttataccaggtgcgtgcggtgtcggccagcacgtagggctgtaccgtcgccagccatttgctctctttacgactgtgcaggtagcgcagctccagttgaccgccatagccgtaatcgccgctggcttcgccgtcctgatagccgcgcccgaaacgctgcgcgccgaactgtacgcgctccggatccggcagcgtggtatcagaccagacgccttccatggatgaactcagtcgccatttctccgtcatcatccagcctgcatccaggttgcctttccagcgggtaaagctgagatcggtaccggccaccggagagacgtccgcgtcaaaggtatccagcccctggcgcaggttcagccgggcgttgatgctggccttactgaattcccggtagccggtgatccccagatccagcgccggataacgggtatgctgactctgggattccagcggaatggtctgcccgaagccgcgcgccaacaggtcgatatcgttacgtttgttggtgtagtccacgccgccggagaggctgatttgcttctggcgggtgagcaacagtggatagccaaaactgatgccgccgttgtattgcgtggattgctgacgggcatccaccgtgaacccgttaagattcagcaagggagtgaactcctcaggatcgtcacgataaaagctgccccgaagctgcatactcagcccttcgtcagtgaggaactgctgataattaagcccgacataagtcttgcgggtttcaccgtccagcgggataaaagtggcgacgccgagctgatcgccataacttgtgaggttgctcaaggtgccgttgaccagcgccaggttttcgcctctgcgcacgtcgagcgtggaagagagatcccagatacgcggctggctggcgtccactttcatcgccgccgcgccataaatattcttcggcagctgcgcattcacatccactttggtgcccggcgtgcgggtcatcagcaggctgtagcgatcgaatgtttcctgtcgcaatggcttttcggtcatcattttttccgccagccgcttcaggcgtgcggcgatgctggcgttgttgctcttaatatcactgtgggcaacatacccttcgaccagcacgatgttaattttgccatggtgaaaattattgtccggcagccaggcataagagagcgggtagccatcggcccggtagcgggcggtaatatcatttaccagccggatgatctctttcagcggtacggttttgcccgcataagggcgaaagggggcaagcaggcttttcagcgggtaaagcttgccgccaataaactgaatatgtttgaccaggatcggcgtatccggggtgagctgcgtggcggattttgggaccgtcaccgtcggcgcgcggcgttgaaccgcagtgggatcctgttcgccaggtacggcttttgacgggttaaccggatcgataatggcggggagggtatccgcccgggcgatgccgagcaccgcgccgcacatgagcgcatagcagaggtgtagtctcatgatgcattcccttcaggaaaacgtgcccccgggcgggggcacggtacagcgtgttattgtttcggttttaatagtccgccaacgataccggtcacgccgctaagcggacctgaggcggtcgttccactggtgtcattgctggttgtcgtcccggcgctggcggtcagtccggcagtcaggttattgaccgtggcgccgacattggctaccagaccggttttactggcatccgccgtcgcatccactgcgataccacccgttgagctggccggaggcgcagtgacggtggctggtttaaccacgccgcccacatccgcaaccgtctggccaaggttgctgaccacctggccgacgccgctcaggcccgcattactgctggtcacctggttacccacaccgctgacgccattgccaacgtgggttaacagattactgaccggtgtgccgaggcctgttgcgccacccacaccctgagtcacatgctctacgcctgcggtagtattgttaaccagcgtggtggtgccggtagtcaggcgggacacgccgtcgctttgcaccacgttagtcagcgcggtccccgtgccgctgacgacctgcccggtgctgttcacgatggcaccggttgggcctgtgaggctgcgtaatgacgatgacgaggtggtgctggcaagattggtgccgacgtcagacacggtgccgcccagcgaggtcacggtagtagtcaccccgcttaatgtcgtgcccacgccgttgacgtttgaacgatcgccgataccgttggtgatgccgctgccggtggtatcaatggcggtgccaacgccgctgacggtggtcgccacggtggaggtcaccggattgctggtgggcaactggctaccgagattatcgagcgtggtacctacgccggaaagggtttcaccggtatcgctgagaatggtgctgaccgcgccgttagcggcagtatctgtgccgcctgagccgccgtcagagccaccacccgtaccgccaccaccacctgtactgccgccggatccgctgccgtcagagcccgatccgttgccgccggaacccgatccgcctgtacctgtgccggaacctccagctccgccattcgcgccgctgccgccagcgcctgtacccgtaccgccggaacctccgccgcccgagccgttgttcgccgttgacgtcccatcgttagtccccgctcctgtgctcgtccctgcggttggcgtttttttcacactggaatgagaaccgccgccgctacaggcagataatgagaatgcaagaagtacggccaccgtaatgacgctcaggtggctaacgttattagtagccatgatcatactccactaaataaaacgccggacggcgtattaatgagtgtaagtagctttttgacggcaacaacttttgttgcatgtatttttaaataaagttaataaattgtgattattcctaataatcaaataaagtgaatttaaaaaaatccttgtttatcagtatctttattttttatgtagaagcgtaagcggcgctgaaaccctgccaggatatgtagccccgattaaattatttataagttaataagcatgctaataactgatgcggatatatcgcatcaaaaacattattttaatatggggcgtaactacgggcggcgaaatattccggacttgatcacacaagcccggatatattcttttaaagctgactttcctgccaggcgaattcaatctcttcggcaagcactttaatgcctgcctcgattttgtccggatcaggaacatagttcatgcgcatacactggtgcgtgtgcggccagggtttgtcgaggccggggaagaaataatcccctggcaccatcagtacgccgcgttttttcaggcgctggtagagcagttcggtggtgatcggcagatctttaaaccacagccagaggaaaatggctccttccggcttgtggatcaggcagcgctcttccggcaaatagcggcgaattgtcgcaaccgtctcctgtacgcgctgctgatagaacggcttgataacggtttccgacaggcgcagcagatcgttacgcttgatcatttcgcacatcatcgccgggccgataccgccgggggcgaggctgatgatgccgttcatattgcggatcgccgagataattttttcatccgcaatgatgatcccacagcggctgccgggcaggccgagcttggagagactcatgcacagcacggtgtttgggttccacagcggacgcgcatcgctgaagatgatcccggggaagggcacgccgtaggcgttatcgatgaccagcggaatgccgtgctgattcgccagcgcgtccagcttcatcagctcatcatcggtgatcacgttaccggtcgggttggtcggacgcgatacgcagatcatgccggtttcttccccgatatgcaggtgctcgaaatcaacgtgatatttaaactggccttccggcagcagttcaatgttggggcgcgccgagacgaaaagatcttcttccaggccggaatcggcatagccgatgtattccggcgccagcgggaacagcacttttctggtgcttccatcggcacgacgacctgcgaacagattgaacaagtagaaaaacgcgctctggctgccgtttgtcagtgcaatattctgcggctcaatatcccagccctgagtttcccgcagcatttgtgcaaggcagaccagcagctctgacttaccctggggaccgtcgtaattgcatagcgcatcagtggctttgccggagctgagcatatcggcaagcagctggtggaaataatcggtcatttccgggatttgcgccgggttgccgccgccgagcatgatggcgccaggcgtgcgcaggccgtcgttgagatcctccatcaggcgggtgatgcctgaatggcgggtgaatttgtcgccgaaaagtgaaaatgtcatagcaggtggtctgtcggtctctttgaatttgccccaccttaacgccagcgcaggcgcggtgcaaatcggacaaaggccggtgtgatggaataaaatgctgctggctgtggttatgatgaatttttatgccgcaggcagagggtggaataaaaaggcgttacaggacggttaacggccagtggacgtagctctgccactgacactcctgatcgataagctcagcgcccagcggatggctggtcagccagtcatgcggcagggacagcgtcagactttcttccaccgccgtcagggtgatggccggcaacaaatcgtcacgacgacggctggcgaaaataatcgccagacgcagcagacggcacaggtgttccgccacgcgcggcggcacggcgttttgctgatgcaacgaggagagatcgaccgtactggtctggttaagcaacagggtcgccagcagctttttctgcgcaggagtgaagcccggcagatccagattgcgtaccagataggcagcgtgctgcggcgcggatttaaaatcgacgctgaggccgatttcgtgcagctgacaggcgctgaccagcagatcgcgcgacagcggctggagatcccagacgccttccacctgcgcggcaaaacgggttgccagctgcgcgacgcgcaaagcctgttcggtatcgaccataaaacggcgctgaatgttacgcagcgtgcggttgcgaatgtcctgatccaccgacagatgcagcatgccgtacaccaggccttcccgcagcgcgccgcctgccagagtcatacactgaatatccagctcggtgaagatggcgataaggatcgccagcccgctcgggaaaaccagcgcccgctccagcgtcaggccttcgatttccagctcctcaagacgaccacactgaatggcgcgctgtttgagctgctgaagtttggccagcgtgatgcgctcgtccatgccctgcgccatcatgatttcctgtagcgcctgcaccgtgccggacgcgccgacgcagactttccagccgtgcgcgcgtagttcattggccaccggacggatcaccgcgcgcgcggcgcgttccgcctcgtcgaagtgctctttcgccagattacggtcggtgaagtaacgctcaagccaggtgacgcagcccatcgacaggctgaacagggacgtggcctgcgcgccggtgccggtcaccagttcggtgctggcgccgccaatatccaccaccagacggcgatcgtcgccaccggtggtgtgcgccacgccctgataaatcaggcgcgcttcttcctcgccgctgatgagttgcaccgggcagccgaggatttcctgcgctttcgtgataaagacatgggcgttgacggccaggcgcagcgtcgccgtggcgaccacctgaatttgtacctgcgggatgtcctgcaaacgttctgcgaacagacgcaggcattgccagccgcgctccatggcttcgggcgagagcacaagatcgctgctcaaacccgccgccaggcggactttgcgtttgatgcggctcagggtctgtatgctccccgccacctcgcgtacaaccagcatatgaaagctgttagagcctaaatctattgcggcgtatagcgaagtagtggtgagcatcttttttaacccggacgacgacgattacgcggtgcgccagggcggcgctgattattgcctggacgggcgcgggtgaggcgcaacggcttcggcagatctttcagtagcgcgtccggattgtatttgctgaccggaatagagtggccggtgtaagtttcaatcgccggcaggttcagcgcgtactcttcgcaggccaggctgatggaatgaccgcttgcgcccgcacggccggtacggccaatacggtgcacgtagtcttcacagtcatccggcagatcgtagttgaagacgtgcgtaacggctggaatgtgcagaccgcgcgcggccacgtcagtcgctaccaggatgtccaggtcgccacgggtgaattcttccagaatacgcaggcgttttttctgcgccacgtcgcctgtcagcaggcctacacggtgcccgtcggcggctaaatggccccagatatcttcgcaacggtgtttagtattggcgaaaatgatggcgcgatccggccactcttcttcaatcaacgtctgcaacagacgcattttttcttcgttagacggatagaacagctcttctttgatgcggtggccggttttttgctccggttcgacttccacatattcagcgttgttcatctgttcaaaagcgagttcacgcacacggtaggacagggtggcggagaacagcatgttgagacgttcagtgaccgcaggcatacgacggaacagccagcgaatgtctttgataaagcccaggtcatacatgcgatcggcttcatccagcaccaccacctgaatcgcgccaagattgatgtggttctgttttgcgtaatcgatcagacgcccggtggtgccgatcagaatgtcgacgccgctttccaggactttaagttgtttgtcatagccatcgccgccgtaggcgaggcctaatttcaggccggtagtctgcgccaggggttcggcatcagcatggatctgcaccgccagttcacgggttggcgccatgatcagcgcacgcggttggttcaccttgcggtctgcgatcgccggatgagagagaagataatgaaacgttgacgtcagaaacgccatcgttttcccggtaccggtttgcgcctgtcctgctacatcacgaccagccagcgttagcgggagcgccagcgcctggatatgtgtgcaattatgaaagcctttgttttcaagggcttcgatcaccttagggtgcagggcgaagtcggtaaacttctgttctgttaaatgtgttttgctcatagtgtggtagaatatcagcttactattgctttacgaaagcgtatccggtgaaataaagtcaacctttagttggttaatgtggcatcaatacgttgtagtttcatgctacatcagcacgccaggcttattcctgtggagttaaatatgagcgataaaattattcacctgactgacgacagttttgacacggatgtacttaaagctgaagggctgaccctcgtcgatttctgggcagagtggtgcggtccgtgcaaaatgatcgctccgattctggatgaaatcgctgacgagtatcagggcaaactgaccgttgccaaactgaatatcgaccagaacccgggcactgcgcctaagtatggtatccgcggtattccgaccctgctgctgttcaaaaacggcgaagtagcagccaccaaagtcggtgcgctgtctaagggtcaactgaaagagttcctggacgccaacctggcataatccagcgcaaacccagcctggcgtgctgcgttcctaattttttgggatcgctggacgcccggcttcagtcgtgctaagtttgttttgacttcgttttaaacatacctttgtagtttgtacccgatacttcccgctgagcaccatcgccgcgagagaagtagatagattccgggcttgtcactcaatccgtcttgtcgtttcagttctgtgttcttcccgtaagcaggcagcgaacagacatgagttgatggccgctaaaacaggcatggatgaccctgccataccattcacaaattaagttcgagatttaccccgagtttaagaacccacaccactatgaatcttaccgaattaaagaatacgccggtttctgagctgatcactctcggcgaaaatatggggcttgagaaccaggctcgtatgcgcaagcaggacatcatttttgccatcctgaagcagcacgctaagagtggcgaagatatatttggcgacggtgtgctggagattttgcaggatggatttggtttcctccgctccgcagacagctcctacctcgccggtcctgatgacatctacgtttcccccagccaaatccgacgtttcaacctccgcactggtgataccatctctggtaagattcgcccgcccaaagagggtgaacgttactttgcgctgttgaaagtcaatgaagttaactacgacaaaccagaaaacgcgcgtaacaaaatcctgtttgagaacctgaccccgctgcacgcaaactctcgtctgcgtatggaacgtggtaacggctctacagaagacttaaccgcccgcgttctcgatctggcctcgccgattggtcgtggtcagcgtggtctgattgtggcaccgccgaaagccggtaaaaccatgctgctgcaaaacattgcccagagcatcgcctacaatcacccggattgcgtgctgatggttctgctcattgacgaacgtccggaagaagttaccgagatgcagcgtctggtaaaaggcgaagtggttgcgtccaccttcgacgaaccggcttcccgccacgttcaggtcgctgaaatggtgatcgaaaaggcgaagcgtctggttgagcataaaaaagacgttatcattctgctcgattccatcacccgtctggcccgcgcctacaacaccgtggtaccggcttccggtaaagtgttaaccggtggtgtggatgctaacgccctgcatcgtccgaagcgtttcttcggcgcggcacgtaacgtggaagagggcggcagcctgaccatcatcgccaccgcgcttgtcgataccggttctaaaatggatgaagttatctacgaagaatttaaaggtaccggcaacatggaactgcatctggcgcgtaaaatcgctgagaagcgtgtgttcccggcgatcgattacaaccgttcaggtacgcgtaaagaagagctgctcaccacgcaggaagaactgcagaaaatgtggattttgcgtaagatcattcacccgatgggcgagatcgacgcaatggagttcctcatcaacaagctggcgatgaccaaaaccaacgacgaattcttcgacatgatgaaacgttcgtaagtcttatcaattttgctggttctggtgaatgatttgacggcggtttgcatcgacaggctgatgtgaagatgcgggaaaaacgcgcagtttctcacttgacggagcgcgcgtaatccaaataaagccccgaaacgccacgttttacgtggcgtttttcttttgcggaatatacgctataaccacggagccacaagatgcttcgggcagcgcgcgatattacggaacattcactataagaatggcctaattgattgaaaaacatacaacagaccctgtgtatgacccgctttattgcttcttgagcaaggtcaacgtcgttatacttccaggatcaacattcgctgagagcatgcattgtgaatttactcactgcggttactgagttattcagtatttttttactcacttttatctttctttttttcgcacggaaaatcgcgaagaaaatcggtctggtggacaagccaaacttccgtaaacgacaccaggggctgatcccgctggtgggcggtatctctgtttacgccgggatttgctttacgttctacattgccgattactacatacctcatgctgctctctacctggcctgtgcgggcgtacttgtcttcgtgggcgcgttagacgatcgttttgatatcagcgtaaaaattcgtgccactatccaggcgcttatcgccgtggtgatgatggccgtcggcaagctttatctcctcagcctcgggcatatttttggctcatgggaactggtgctcggaccgttcggtttcttcctgacgctgtttgccgtctgggctgcgattaatgccttcaatatggttgatggtattgatggcctgctcggagggttgtcctgcgtctccttcggggccattggcatcattctgtggttcgacggtcagaccagccttgcgatgtggtgcttcgccatgatcgccgccatcctgccttatattctgctgaaccttggtgtgcttggccgccgctataaagtgtttatgggcgatgcgggcagtacgctgattggttttaccgtgatctggatcctgctggaaaccactcagggccaacgccatccgataagcccggtcacggcgctgtggatcatcgccattccattaatggacatggtggcgattatgtatcgtcgtctgcgtaagggcatgagcccgttctcaccggatcgtcagcacatccaccatcttattatgcgtgccggctttacctcccgtcaggcattcgtccttatcacgctcgctgccgccctgctggccgctatcggcgttgtgatggaatatgtacatatcgtaccggaatgggtgatgttggcattgttcttgctagcatttttcctgtacggctactgtattaaacgggcatggaaagtcgcacgcttcattaaacgtgtgaaacgccgtctccgtcgcaaaagcagacataatccaccattaaccaagtaattctgggatagcgatgactcaaccattaccgggagcacaatcagtaggtacggagaatgaactggatattcgtggtttgtttcgtactttgtgggcagggaaattctggattgcaggtgtggcgctggttttcgccttgatcgtattaccctatacctttttcgcgcgtcaggagtggagcgccacggcgatgaccgatcggcctaccgtgaacatgcttggcggctactactctcagcagcagttcctgcgtaatctggatgttaaagccagcctggcgccggtcgatcagccttcggtaatggacgaggcctataaagaatttgttatgcagctggcgtcatgggatacccgccgtgatttctggttacagaccgattattacaagcagcgtacggtgggcaacagcaaagccgatgccgcgatgctggatgaattaatcaactacatccagtacacgcctggcgacgccctgcgtaacctgaatgacaacgttaagctgacggcggaaacggcgccggacgctaacaatctgctgcgtcagtatgtggcctttgccagccagcgcgctgccagccatctgaatgatgagctgaaaggcgcatgggccgcgcgcactattcagatgaaggcgcaggtgaaacgtcaggaagaggtggcccgcgctattttcaaccgccgtgtccacagcgtggaacaggcgctgaaagttgccgaacaacacaatatttcccgcagtgaaaccgaggtgccggccgacgaactgcctgattcagaaatgttcctgctgggccgtccgatgctgcaggcgcgcctcgaaaacctgcgttccgtcggcccggagtttgacctggactatgaccagaaccgtgccatgctgaatacgctcaacgtcggccccacactggatccccgttttcagacttatcgttatttgcgcacaccggaagaaccggtaaaacgcgacagtccgcgtcgtgctttcctgatgatcatgtggggaattgtgggggcgttagtcggagccggtgtagcgttaacgcgtcgtcgctcatactaaacgccgtctgagatgaaggccgccgtgccttcatcatctaatcgaagagaatcgttgtgaaagtacttaccgtatttggcacacgaccagaggccatcaaaatggcgcctctggttcatgcactggcaaaggatccttatttcgaggcgaaagtgtgcgtcaccgcgcagcatcgtgagatgctcgatcaggtgttacatctcttttcgatcgttccggactacgaccttaatattatgcagccgggtcaggggctgacagaaattacctgccgcattctggaagggctaaagcccatcctcgaatcttttaagccggatgttgtgctggtacatggcgataccactaccaccatcgccgcaagcctggccgcgttttatcagcgtattccggtaggccacgtggaagcgggcctgcgcaccggcgatctctcctcgccgtggccggaagaagccaaccgcaccctgaccggtcatctggcgatgtaccactttgcccccacggaaaatgcccggcataacctgctgcgggagaacgttgccgataagaaaatttttgtcaccggcaataccgttattgatgcgctgttctgggtacgcgataccgtgctgaacaacgaggcgctgcaaaacgagctggccggacgctatccgtttatcgataaatccaaaaagctgatcctcgtgaccggtcatcgccgcgaaagctttggtcgcgggtttgagcaaatctgtcacgcgctggcggacatcgccgccgcccatgatgatgtgcagattgtctatccggtacacctcaaccctaacgtcagcgagccggtaaaccgcatcctggggcacgtggataacgtgattctcatcgagccgcaggattacctgccgttcctctggctgatgaaccactcgtggctgatcctgacggattccggcggcattcaggaagaagcgccttcattaggcaagccggtgctggtgatgcgtgacaccactgagcgcccggaagccgtggaagccggtacggtcaggctgatcggtaccgacagacagcgtatcgtggatgaagtcacgcgcctgctgaccagttttgatgcgtggcaggcgatgagccacgcgcacaatccgtatggagacggtgaggcctgcggtcgaattttgcacgcacttaaacacaatcgggtaacgctatgagcttttcaaccatttctgtcattggccttggctacatcggactgccaaccgcggcggctttcgcctcccgtcaaaagcaggtagtgggtattgatatcaaccagcacgcggtggacaccattaatcgcgggcaaattcatattgttgaacctgaactcgacagcgttgtaaaagcggcggttgagggcggttttttgcgcgccagcaccacgccggtggcggcggatgcttacctgattgccgtgccgacgccttttaaaggcgatcacgatccggatatggcctacgtggaagcggcagccaaatccatcgcgccggtgctgaaaaaaggcgcgctggtgatcctcgaatccacctcacctgttggcgcgaccgaacaaatggcgcagtggctggcggaaatgcgtccggatctgagcttcccgcagcaggcgggcgagcaggcggatattaatatcgcctactgcccggagcgcgtgctgccaggccaggtgatggttgaactgatcaaaaatgaccgcgtgatcggcggcatgacgccggtgtgctccgcccgcgccagcgagctgtacaacatcttccttgaaggtgagtgtgtggtcactaatgcccgcaccgctgagatgtgcaaactcaccgagaacagcttccgcgacgtcaacattgcctttgccaacgaactgtcgctgatttgcgccgaccagggcattaacgtctgggagctgatccgcctcgccaaccgccacccgcgcgttaatattttgcagccgggaccgggcgtgggcggacactgtatcgccgtcgacccgtggtttattgtgtcgcaaaacccgcagcaggcgcggttgatccgtaccgcccgcgaagtgaacgacagcaaaccgcagtgggtgctgaatcaggtgaaagccacggttgccgactgcctgacggcgagcggcaaacgcgccagcgaacttaacatcgcctgcttcggcctggcgtttaagcccaacattgacgatttacgcgaaagcccggcaatggaaatcgcccgccagatcgccgaatggcacagcggcaacaccctgatggtggagccgaatattcatgcgctgccgaaaaaactcgccggtctgggcgaactggtgagccttgacgacgcgctggcaaaagctgacgtcatcgtcatgctggtggatcatcagcagtttaaagctcttcccggtgaagcgatcacgcagcagtatattattgataccaaaggcgtctggcgatgacagccccgtcctttccgctgcacggtacggttgagcctcttggctgggaaagccagtttttcggcctgcacagcgctattgtgcgcctgagcgacagcggcccggcgatcaccgaagccgatctcaacgcctgggaacgggtgcaggtcaaaattccggccagcgatgcggcacggctggacgcgctgcaacagcgcggttttcagctggtggaaggggaagtggatctcgcgctgaacctctgcgcgacggtggccgatccgcaggcgcaggtcgccggcgctgaagatattccgcggctgcgcgagctggcggcacaggcattcgcgcaaagccgttttcgcgcgccctggtatccgccagaagccagcggacgtttttacgcccagtggattgaaaacgccgtcaaaggcgagtttgatcaccagtgcctggttttccgcgccgctgacggcgacatccgggcgtttgtctccctgcgccagctcaatgaccatgaggcgcgtattggcctgctggccgggcgcggcgcgggtgaagccctgatgcaggcggcgtcatactggacgcagacgcgccagctgacaaggttacgtgtggcgacgcaggcgggaaataccgccgcgcttaaacgttatattcaaagcggtgcgaatgtggaaagcaccgcctactggttatacaggtgacatgatgatcccttttaacgcaccccccgtagtaggcagtgagcttgaatacatgcagtcggccatgggaagcggcaagctgtgtggcgatggtggttttacccgtcgctgtcagcagtggatggaacaacgctttggcagcgcgaaagtgctgttaacgccgtcctgcaccgcgtcgctggagatggccgccctgctgctggatattcagcccggcgatgaggtgatcatgccgagctataccttcgtgtccaccgccaatgcctttgtgctgcgcggcgcgaaaatcgtctttgtcgatattcgcccggacaccatgaacattgatgaggcgcgcatcgaagcggcgatcaccgaaaaaacacgcgccatcgtgccggtacactacgcgggcgtcgcctgtgaaatggacaccatcatggcgctggcgaagcagtacaacctctttgtggtggaagatgccgcgcagggcgtgatgtcgacctacaaaggccgcgcgctggggacaatcggccatattggttgctttagcttccacgaaaccaaaaactacaccgccgggggtgaaggcggcgcgacgctgatcaacgaccgcgcgctcattgagcgggccgaagtgatccgcgaaaaaggcaccaaccgcagccagttcttccgtggtcaggtggataaatacacctggcgcgatatcggctccagctatctgatggccgatttgcaggccgcctacctgtgggcgcagctggaagcggcggatcgcatcaatcagcaacgcctgtcgctgtggcagacctatttcgacgcgctctccccgctggcacgcaccggtcgcattgaactgccgacggttccggcggattgcaaccacaacgcccatatgttttacatcaaactgcgcgatgaagccgaccgcagcaagctgatcgccttcctgaaagaggcggagattctcgcggtgttccattacattccgctgcactccagcccggcgggcgaacagtttggtgagttccacggcgaagaccgttacaccacgcaggaaagtgagcgtttgcttcgcctgccgctgttctacaatctggcaccggtcaatcaacgtacggttatcagcaccctgctgagctattttaactgagatgtcgctggctaaagcttcggtgtggaccgccgcgtccacgctggtcaagattggcgcgggactgctggtggtgaaactgctcgccgtggcttatggcccgtcgggcgtcggccaggcgggtaacttccgccagctggtgaccgtgctcggcgtgctggccggggcgggtattttcaacggcgtcactaagctggtggcgcaataccatgacgatacggcgcagctacgcaacgtggtcggcacctcgtccgcgatggtgctgggtttctcgacgctgctggcgctggttttcctgctggcggcggcgcccatcagccaggggctgtttggtcatacgcattttcaggggctggtccagctggtggcgctggtacagatgggcatcgcctgggcgaacttcctgctggcggtgatgaaaggctttcgcgatgcggcaggaaacgcgctggcgctgatttgcggcagtattgtgggcgtgatggcctattatgcctgcttccgcctcggcggctatcagggcgcgttactggggctggcgctggtaccggcgctggtggtgatcccggcgactgtgctgcttatccgccgtaaaactattccgctgggttacctgaagccgcaatgggataaactgttcgccgggcagctggcaaagtttaccctgatggcgctcattacctccgtcaccctgccggtggcctatgtgatgatgcgaaacatgctcgcggcgcattacagctgggacgaagtggggatctggcagggggtcagcagtatttctgacgcctatttgcagtttattaccgcctcgttcagcgtttatctgttgccgacgctctcgcgcctgacctcgaaacaggacatcacccgtgagatcgtcaagtcgctgaaatttgtattaccggcagtggcagcggcgagtttcaccgtctggttgctgcgggatgttgccatctggctgctgttctctgacaaatttatcgccatgcgtgacctgtttgcctggcaactggtgggcgatatactgaaagtgggtgcttacgtcttcggctatctggtgatcgcccgcgcctcgctgaaattttatattctggcggaaatcagccagtttgccctgctcaccggattttcccgcgtgctgatcccggcgcacggcgccgcaggcgcagcgcaggcctatatggctacttatattgtttatttcgccatttgttgtggcgtgtttttgctctggcgtaaacgggtatgactgcactcattcatgtactgggatcgaatatcccacaccataatcaaaccgtgctgcggttttttaacgatcacctcgcctccacaggcgagcatgcgcgcgaatttatggtcgccgggccggatgacggctacagcgccgcttttcccgcgctgcgactgcgtttctttgccgacaaaaaatccctggcgcaggcggtcatctcgctggcaaaagccgatcgcgggcagcgctttttctttcatggtcagtttaatactgacctgtggctggcgctgctgcgtggcacgatcaagccgcagcagttcaactggcatgcctggggcgcggatctgtatgaagtgtcgcagagcctcaagtttcgcctgttttatccgctgcggcggctggcccaggcgcgcgtcggctgtatctttgccacgcgcggcgatctgcaattttttgcccgtcgccatccgcaggtgcgcggcgagttgctctacttcccgacacgcatggatccgtccctcaatactatggcgcctgccgtacgtagcgaaggcaaactgaccgtgctggtgggcaattccggcgatcccagcaatgagcatatcgctgcgctgaaggccattcaccagcagtttggcgatacggtgaacgtcattgtgcctatgggttatcccgcgaataacgaggcgtatatcgcgcaggtccggcaggcgggtgaaaccctgttcagcccgcagcatttgcgcattctcagcgagaaaatggaatttgcggaatacctggatttactgcgccagtgcgatttgggctattttatctttgcccgtcagcaggggatcggcacgctctgtctgctgatccaggcgggtgtgccgtgcgtgctcaatcgtgaaaatccgttctggcaggatatggtggagcagcacattccggtgctgtttaccggtgatgcgctgaacgaggcggtggtgcgcgaagcgcagcgccagctggcggcggtggataaaaacgccattaccttcttcagccctaactatctgacgccctggcatcaggcgctgcgtatcgcggcgggagaggtggcatgagtcagcttgagttctgcggattactggtcatctggctgctggcctcgctgtttatcggcacgctgacgtggtttgaattccgccgcgtacgctttaacttcaacgtgttcttctcgttgctgtttttgctgaccttcttcttcggtttcccgctcaccagcgtgctggtgttccgcttcgacgtgggcgtggccccgccgggcattatgatgcagagcctgctggcggcggcctgtttctatgccatctattatgtgacctataaaacccgtttgcgcccggtagggcaggaacgcgaacgccgtccgctgttcaccattaatcgggtggaagcgcatctggcgtgggtgatgctgatggggatcgcgctcatcagcgtgggtattttctttatgcacaacggctttttgctgttccgcctgcattcgtacagccagattttctccagcgaagtctccggcgtggcgctcaagcgtttcttctacttctttattccggcgatgctggtggtctattttctgcgccaggacgggcgggcatggctgttcttcctcgtcagcaccgtggcttttggcctgctgacctatatgatcgtgggcggtacgcgcgccaatatcattatcgccttcgccatctttttatttatcggcatcattcgcgggtggatctcgctgtggatgctggcagcggcgggggtgctcggtattgtcggcatgttctggctggcgcttaagcgttacgggctgaacgtcagcggcgacgaagctttttataccttcctctacctgacgcgcgataccttctcgccgtgggaaaacctgtcgctgctgctgcaaaactacgacaaaatcgacttccaggggctggcgcccattgtgcgcgatttctatgtgtttatcccgacctggctgtggccggaccggcctggcattgtgctgaataccgccaattactttacctgggaagtgctgaataaccactccgggctggctatctcgccgacgctgatcggttcgctggtggtgatgggcggcgtatggtttatcccgctcggtgccgtagtggtggggatgatcattaagtggttcgactggctgtatcagctgggcaaccgggaaaccaatcgttataaagcggccattctgcacagcttttgtttcggcgccattttcaacatgattgtgctggcaagggaagggctggactcgttcgtctcgcgggtggtctttttcctcgttgtctttggggcctgtctggtgctggccaaactgctgtactggctgtttgacagcgccgggctgatccatgcccgcgtgctgcgcgcccacaaaaccctttcacaggtctgataaggaatcccatgactgacaaaaccgacgccccggtgtacaccctgcgcgggctgaagctgattggctggcggaatatgcaacatgcgctggatcacctctatgccggaggcgcgctgaagcagggcacgctggtggcgatcaacgccgagaaaatgctcgccgtggaaaatgacgcccaggtgcgggccctgattgaagcggcagagtataaatatgccgacggcatcagcgttgtgcgttccattcgcaaaaagtatccgcaggcgaaggtcgagcgcgtggccggggcggatttatgggaagagctgatggcgcgtgccggaaaagagggtacgcccgtctttctggtgggcggtaagccggacgtactggcccagacgcaggaaaagctgcgcgcgcagtggcaggtgaatattgtcggcagtcaggatggctacttcactgcagaccagcgtcaggcgctgtttgagcgtatccgcgacagcggcgcgaaaatcgtcaccgtggcgatgggctcgccgcgccaggagatcctgatgcgggattgccgcgaggtatatccgcaggcgctctatatgggcgtaggcggcacctatgacgttttcaccggccatgtgaagcgtgcgccgaaagtgtggcaacgtatgggtctggagtggctttaccgcctgttatcgcaaccgagccgcctcacccgccaactgaagctattgcgctatcttgcctggcactatcgcggccagatgtaatcgacaggcagcgcggtgcaatgcgccgcctgcttttttattgagcaactcatacgtttttgttaaccatcgtttgccattttccccgaattaagaaaccattcgcccactcaatgcattgcactgagtcataactataacccgcaccgccgggaacagtagcagacacaacagaggatttatggccgagaacaaaccggagcttcagcgtgggctggaagctcgacacatcgaacttattgccctcgggggcacgataggcgttggcctgtttatgggcgcggcgagcaccctgaaatgggcagggccatcagtattgctggcatacattattgccgggctgttcgtcttcttcatcatgcgctccatgggcgaaatgttattccttgagccggtcgccggttcctttgccgtgtacgcgcaccgctacatgagcccgttcttcggctatctcaccgcctggtcctactggtttatgtggatggcggtgggcatctcagaaatcaccgccatcggcgtgtatgtgcagttctggttcccggaaatggcgcagtggatccccgcgctgatcgccgtcgggctggtggcgctggcaaaccttgccgccgtgcgtctgtacggtgaaattgagttctggtttgcgatgatcaaagtcaccaccatcattgtgatgatcgtggtagggctgggggtgattttcttcggctttggcaacggcggccatgcgattggctttggcaacctgacagagcacggcggcttcttcgcgggcggctggaaaggcttcctgacggcgctgtgcatcgtggtggcgtcctatcagggcgtggagctgattggtattacggcgggcgaagcgaaaaacccgcaggtcacgctgcgcagcgcggtaggtaaagtgctgtggcgcatcctgattttctatgtgggcgcgattttcgtcatcgtcaccattttcccgtggaatgaaattggcagcaacggcagcccgttcgtgctgacctttgcgaaaatcggcattaccgccgccgccgggatcatcaatttcgtggtgctgaccgccgcgctttccggctgtaacagcggcatgtacagctgtgggcgtatgctgtatgcgctggcgaagaaccgccagctgccggcagcaatggcgaaagtctcccgtaacggcgtaccggtggcgggcgtggcgatctctatcgtcattctgctgattggctcctgcctgaactacatcatccctaacccgcagcgcgtatttgtgtacgtctacagcgccagcgttttgccggggatggtgccgtggtttgtgatcctgataagccagctgcgtttccgtcaggcgcataaagcggccattgccacccatccgttccgctcggtgctgttcccgtgggcaaactacgccaccatggcgtttttgatttgtgtactgattggcatgggcctgaatgaggacacccgtatgtcgctgtttgtgggcatcatcttcctcgccgcagtcacggtggtttataaggttttaggccttaatcgctatacgcagcctgataagctggggaaataagcagcaaaatgcgcaaagcataaccaaacgcgcattttctggagatttcttttaaaaagcactagacaggtacgcccgaagtccgtactatccacccccgcaacggcgctaagcgcccgtagctcagctggatagagcgctgccctccggaggcagaggtctcaggttcgaatcctgtcgggcgcaccatttacccggtgctggagctgcggtggcctgtgatggtagcagggccgcgtgaaagaatatcagtggtggctatagctcagttggtagagccctggattgtgattccagttgtcgtgggttcgagtcccattagccaccccattagttacaaagagtaccgtggaatgcgaaggtggcggaattggtagacgcgctagcttcaggtgttagtgtccttacggacgtgggggttcaagtcccccccctcgcaccacaaattgatttaactaaaaagtcaaaaagcagtatttcggcgagtagcgcagcttggtagcgcaactggtttgggaccagtgggtcggaggttcgaatcctctctcgccgaccaattttgaaccccgcttcggcggggttttttgttttctgcctttcctcactgttatcgcctcttttccctgttgtttcctgcttgttgcttttcggcgacgtcgccgccgatgaatgtcgcggataggagacagatatccctctgttttttaatcatatttttataatgactccattttgtcgccattaagcgacaattttcccgcgcaacatcacaaaattacctgtgacctgacgcgtaacgtgatgaaaatccaaaaatattaaaagattcagagctacgagatttagggataaaaatctggcacgggttgtgcaataatatatatgtagatgctcattccacctcttatgttcgccttagtgcctcataaactcaggaatgacgcagagccatttaatggtgcttatcgtccacagacagatgtcgcttcggcctcatcaaacaccatggacacaacgttgagtgaagcaccgatttgttgtcacacagacctgttaatgcccgttctggtttcagaacgggcatttttttatgccctctcccggtgggagagggtgacgatgggggaaattactgcggcgggttgttttgcagggtcaacagcaggccgtcacgacgcatagtggcggcttcttcaggcatatgcagacgatccagcgtatcggcaagccaggcgtagtcaaaggcatccggacgctgtttcagcgcggcgcggaacgccagactggcttctttccattcaccatgcttaagcagcgactgacccagcgtactccacaggagcggacgatcgccctgggttttgatctgctgacgcagcactttttccacctgctcaggattattggtcttcagccgtgggatcaccatgaccagccggtcgtcgtaatgacgtttcaggccatcaagcaggatctgctgggccgtgtcatgatcgtcacattcgattaaatgttcggccatcgccacctgcagcgccacctgttgacgcgttttacggctctggtttttccaccacgctttcagaccatcgctgccctgatcggcacgagcctgatccatcaacccaatccacgcctgctgtgcaagggcatcacgatgggcttcatcagcgacgtccgctttggccatagacggcagaatatcgagcagggaaccccaggcgccggtacggatatacgcctgctccgccagacgcagcacttccggatggcgcggggtgatttccagcagtcggtcgacgccgtggcgcgccgcatggttttcattgcgcgccagttgcagacgaacacgggtgatttccaccgggatctgatcgttatccgccagctccgaggcgcgctccagatgttgattggcgcgcgcttcatccccgcgctgctgggcggcttcagcggcgagcaggtagttcaccaccggctgttcagcgtgatcggcatttttcgacatcagcttttcaacctgctgataatcgccttccgccagcttgagcagtgcctgttccgtctgtttacgggcgcggcggcgtttacggccggcaaaccagccgcgggtatgtgccccggtgcgtataatgcgacgtaagatccattcgatcacaaagagtacgaccatggcgaggatcagaatgatcacaaggccggtcacactggtttcgatattgtaattgtccgtctggatcagtacgtaaccctgatgcccggcgaccatcggcccgagcacgatcccggctaacagcaatgcaaagagtaataatacttttaacatgattattctccctgcggcgcagcggcaggcgcgtcttgcgcagcctcacccgcggccgcacccggctgtgccagcagattgcgcacgcgggtctgcatcagtttttcaaggatcggctggctttgcagcgtctccggcacgttcatggtgatgctttgctggctcagcttatcaatatcgtccaggaaggctttggtgctggcatcgtcggtatcgtaataagcacgtacccagctggagacgttatccagcgcctgtttgtaagtctcttcctgatgacgtggcacagcctgggctgcgaccagcagccgcgagcgaatgttttcgcgcaggtagatgtcctggttcggcgccagcagcggcacggccgtttcatcgcgacgacgcacggtaataaagctgtccataaagttctgccagcttttttgcagattgacacgccactcgctgatggagctggacagctcgctgctgtcggaatccatcggagaatcgtcgtcgttgttgtccgccagacgcagattatcgatctggttggacagctggttcactttgaggatgatgccgtcgtaatccacctgcgcgacgccggaaaggctggcgatgtcatcagtaatggcgcggcgggcagtgatgaggctcggatcgttcatgtcggcgaggcttgcatcggcgcttttcagcagcgccgcagcggtggtgacgtcctgatcgctccacagtttgcgaccggccagtttgacgaggaaatctgcctgcgccagcagccaggttttggcgtcggtgccggaaatagtggcgactttttgctgcacgtcttcaagctgtttcgccagcgttgcctgctgacgctgcgcctcttccagctgtgaagcctgctgcttaatgatgccctcgaactgggtcttttgggtttcctgcgctttttgcagggcagtaacctgattgaccagcgcatcgctggtttcggattgtgtcgcgttctgctgtttcacccagccatacagcccaaccccggcggccagcgcgatggcaattgcaatggcgctgagcacaagactggttttattcgcgttcgcgcgttcatgttctggtgctttttctggctgtggactggtgtccaccgcctccctggtttcatcgaccacggcggagtctttctgttgttccgtcattatggcttcccattatgaaagttattgtaatgcgcgaagcagcgcatcgttgtcagcattatcagcgaccttaatgtcctgccagcccagttcccgggcgaggttcgccagacgttcgctgaccacaatcaggcggcagcgaagtaaccagttttcacgataccaggcggggatcaggtcgaaaagttgccgcagcatctcgccgctggtgatcacaatgtccgtgaccccgcgagactgccagcgcatcgcctgttccgcgccatcgtaagacttctcacagcgttgataacattcaaaaaattcgacatccgcgccccgtgacgccagcgtatccccgagcaattctcgtccgccgttgccgcgcaaaatgatggcgcgtttgcctgcaatattttgtaattcaggtaattgtagcaacacttcgctgatttcccgatccgaaggatagcgcacgttgaggctgctggcggtgtgcaatgccagcgccgtggtgcggccgatagcgaaatagtgcggcgcgtggggccagcgcaggccaagcttacgcaggtgcgcgctggcgaaggtgacggcatgttgtgaggcggcgaaaaccatatcgttcgccgtcagggcggcaaacacttccggcagcagcgccagctcccgccctggggtaaattcaatcagcgggaagctccaggccacctggccctgtgcgcacagacggctcacaagttcttccccggctggggacgggcgggtgaccagaatactcatgcgggtgcttctcctttatagacctcggtcaggatctcgcgcgcgccgttcgccagcagctcttcggcaagggaaatgcccagctgttctgcctcttcaggcttaccgcgtcgctcaccgcggatcatcacggtgccgtccggcgcgccaaccagcgcccgcaaccagatctcaccgtcgactaattcagcatagctgccaatcggcacctggcagccgccttccagccgcgtattcatcgcccgctcggcttttacgcgtagcgcggtatcggcatgattgagcggagccagcagggcatgggtgcgggtatcgtccagacggcactcgataccgaccgcgccctgaccaacggcgggcagcgacagctcaggcggcagcgccatgcggatacgatcttccagatcaagacgcttgagaccggcgaccgccagaataatggcgtcatagtcgcccttatccagcttgccaagacgggtgccgacgttgccgcgcagcgagcggatctccagatccgggcggcgttcggccagttgacactggcggcgtaaacttgacgtgccaacgatgctgcctgcgggcagggcgtcgaggctgtcataattattggagacaaaggcatcgcgcgggtcttcacgctcgcaaatggtgaccaggcccagccccttcggaaactcaaccggcacatctttcattgagtggacggccagatcggcacgattttcaattagcgccagttccagctctttaacaaacaatcccttaccgcccacttttgccagcggcgtatcaaggatcacatcgccgcgcgtcaccataggcaccagctcaacggtcaggtccggatggcacgccatcaggcgctgcttaacgtattgtgcctgccagagcgcaagggggctttggcgtgtggcaattcttaaaacattgtctaacatgcttgttaccgtcattatcgtccgttgaccatcctaacattgttgccatagggtgtcaggtttcacggaggattgcgggaaagagggacgtagccgtatttgggaatttacacataatgattgatgctacacttgtatgtagtgcatctttctttacggtcaatcggcaaggtgttagattgatcacgttttagaccattttttcgactgtactcctaaaaacacaagggcgaaaaagtggcgacgggtaattttgaaatactgaaatctgaacagttcggtgacgggaaggccatcgcaaccgcaaccgggaaggtttaaacatcaggcgatacgtcttgtacctctatattgagactctgaaacagagactggatgccataaaccaactgcgtgtcgatcgcgcgctggctgctatgggacctgctttccagcaggtatacagtctgctgcctacattgctgcattaccaccatccgctgatgccgggttacctcgacggtaacgttcccagtggtatttgcctttacacgcctgatgaaacccaacttcactatctgaacgaactcgacttgccgccgcaggatacccctccgcagggcgaactgccgatcaccggcgtgtactccatgggcagtacctcgtcggtagggcaaagctgttcctcggatctcgatatctgggtctgccatcagtcttggctcgataacgacgagcgccagcttttgcagcgcaaatgcagcctgctggaaagctgggccgcctcccttggcgtggaagtcagcttcttcctgatcgatgaaaaccgcttccgtcataacgaaagcggcagcctcggcggcgaagactgcggctccacgcagcatattttgctgctcgacgaattctatcgcaccgcggtgcgtctggccgggaaacgtattctgtggaatatggtgccgggcgacgaagaagatcattacgacgattacgtcatgtcgctttacgcgcagggcgtgctgacgccaaacgaatggctggatctgggcggcttaagctccctgtccgccgaagagtacttcggcgccagcctgtggcagctgtataaaagcatcgattccccgtacaaagcggtgctgaaaacgctgctgctggaagcctattcctgggaatatccgaatacccgcctgctggcgaaagatatcaaacagcgtctgcacgacggcgagatcgtctcttttggtctcgatcactactgcatgatgctggagcgcgtgaccgcctatctgacggctatcgaagattttacccgtctcgacctggtacgccgctgcttctacctgaaagtatgcgaaaaactgagccgcgaacgcgcctgcgtgggctggcgtcgtgaagtggtcagttcgctggtgaaagagtggggatgggacgatgagcggcttgccatgctcgacaaccgcgccaactggaaaatcgaacaggttcgcgaagcgcacaatgaactgctggatgcgatgatgcaaacctatcgcaacctgatccgtttcgcgcgccgcaataatttaagcgtttccgccagtccgcaggatatcggcgtgctgacgcgtaaactgtatgccgcctttgaagcgctgccgggcaaagtgacgctggttaacccgcagatttcaccggatctttcggaaccgaatctgacctttatccatgtgccgccgggccgtgccaaccgcgctggctggtatctctacaaccgtgcgccaagcatggacgccatcatcagccatcagccgctggaatataaccgctatctgaataagctggtggcctgggcgtggtttaacggcctgctgacttcacgcacccggttgtttattaagggcaacggcgtggcagatctggcgaagctacaggaaatggtggcggatgtgtcgcaccacttcccgctgcgtttacccgcgccgacgccgaaagcgctctacagcccgtgtgaaattcgccatctggcgatcatcgtcaatctggaatatgacccgacggcggccttccgcaatcaggtggtgcattttgatttccgtaagctggatgtgttcagcttcggcgagcagcaaaactgcctggtgggcagcgtcgatctgctttatcgcaactcatggaatgaagtgcgtaccctgcacttcaacggcgagcaggcgatgatcgaagcgctgaaaaccattctcggcaaaatgcatcaggacgccgcgccgccggacagcgtcgaggtgttctgctacagccagcatttgcgcggtctgatccgtacccgcgtgcagcagctggtgtccgagtgcatcgaattacgcctctccagcacccgtcaggaaaccgggcgcttcaaagcgctgcgcgtggcggggcaaacctggggactgttctttgaacgtctgaacgtgtcagtgcagaagctggaaaatgccatcgagttttacggtgccatttcccacaataaactgcacgggctgtcggtacaggtcgagaccaatcaggtcaaactgccgccggtggtggatggttttgccagcgagggcattattcagttcttcttcgaagcctcggcggataacaacggctttacgatctacatccttgatgaaagcaaccgcgcagaggtgtatcaccactgtgaaggcagcaccgaggaactggtacgcgacgtcagccgcttctactcctcgtcgcacgatcgctttacctacggctcaagctttatcaacttcaacctgccgcagttctatcagattgtgcaggtgaacgggcgcgcgcaggtgatcccgttccgcaatcagacaatcagcgccgttcctcctgccaatcaggatgacgacgctccgctgttgcagcagtatttctcttaacggaagctgaccgcttcgcccgcttgctgcgtggcggcctgctccagcagatcccagaagcgctcgccgctgcgatcgcaaatccactcatcgccctgcaaatcaaaatggtagccgccctgtttggtcgccagccacacctgatgcagcggctcctgacggttgataataattttgctgccgttgtcgaacgtcagggtcagcacgccgccgttgatttcgcagtcaatatcgccgtcgccgtcccactcatccagacgggtttcaatggtctgccacaggttatcggccaggcgatggaattctgaatcgttcattttttttcctttttttcgtgatgccgggagtataacgcgaaacaattcccaatgcaggaggtgcgcaaactcttgcttttgcggcttctcctgcgatgatagaaacagcaagcatgaacttacaggcaaaccataatgaagaatgtgttccgaacgctttttgttttcgttgcgttatgcagtctggccggctgtggtctgaaaggcccgctctatttcccgccagccgataagtcagcgccgccgccgaccaaaaaggtagaaagcaccgagcaagaactgacgccgacgcgtaacgatcgtggcaacaatgacggccctactcaggtaaattactaacagattttattctgtaaccgcgggaatggagtagatgatgcagttctctaaaatgcatggccttggcaacgattttatggtcgtcgacgcggtaacgcagaatgtctttttttcgccagagctgatccgccgtctgtccaaccgacatctgggggtgggttttgatcaactgctgatcgtcgaaccgccttacgatccggatctcgattttcattaccgcatctttaacgccgatggcagcgaagtctcccagtgcggtaacggtgcgcgctgtttcgcccgctttgtgcggctgaaagggctgaccaataaacgcgatattcgcgtcagcacggccaatggccgcatggtgctgagcgtcacggaagatgagctggtgcgcgtgaatatgggcgagccaaactttgagccgtccgcggtgccatttcgcgccaacaaagcggaaaagacctatattatgcgcgttgccgagcagactattctctgcggcgtggtttctatgggcaatccgcactgcgtcattcaggtggatgatgtcgacagcgcgccggtggaaaccctcggcccggccatggaaagccatgagcgcttcccggagcgggctaatatcggctttatgcaggtagtaaagcgcgaacagatccggctgcgcgtctttgagcgcggtgccggtgaaacccaggcctgcggcagcggcgcttgtggggcggttgcggtcggtattcagcaaggcttactggcggaagaggtgcgcgtggatttaccgggcgggcgtctcgacatcgcctggaaggggccgggccatcctctgtatatgactggcccggcgacacatgtttacgacggatttattcatttatgaagcagacaggggaagaacagcaggaggcgacggccacactcaatgacagtgatgtggtggattatctgctgcgcgatcctgagttctttatccgtaatgcgcgcgccgtggaactcctccacgtgccgcacccggtgcgcggcgccgtctctctcgtcgaatggcagatggcgcgcgcccggcatcacatcaatgtgctcgaagagaatatgacgctgctgatggagcaggccagcaccaacgaaagcctgtttaaccgtctgctgcgtttgcagggccgtctggcgtccgccagcagccttgaggatttgctcaaccgttttcaccgctggtcgcgtgaaatgggcctggcgggggcgagcatccgtttatttcccgatcgctggcgcattggcgcgccgtccggcttcacccatctggcgctgagccgtcaggcctttgagccgctgcgtattcagcgccttggtcatgaaaatcactatcttggtaccctgaacggcccggaattactggtgatactccctgacgcgaaagccatcggctcggtggcgatgtcgatgatggggcgtgacggcgatcttggggtgatcctcttcagcagccgtgacgtgcaccattatcagcaagggcagggaacccaactgcttcaggagattgccctgatgctgccggagctgctggagcgctggatcgagcgcatatgaacgacacctctcttgaccatgcggtaagccgttttctgcgctacctgggcgttgagcgccagctcagccccattaccctgctcaactaccggcgtcagctcgatgccatcatggcgatcgcccgtgaaaccggtattacccgctgggcagattgcgatgccgccagcgtgcgcaccattgcggttcgcagccgtcgtcatggcctgggcgcggccagccttgcgctgcgcctgtctgccctgcgcagtttcttcgactggatggtgtcgcagggtgagttgcccgccaatccggcaaaaggcatcgccgccccgaaagccccgcgtcatctgccgaaaaatattgatgtcgatgacgttaaccgcctgctggatatcgatctcaacgatccgctggcggtgcgcgaccgggcgatgctggaggtgatgtacggcgcgggtctgcgtctgtcagagctggtcgggcttgatatcaaacatctggatttatcaaccggcgaagtatgggtgatgggtaaaggcagcaaagagcgccgtctgccgattggccgtaacgcggtaagctggatcgagcactggctggatctgcgcggcctgtttggcagcgatgaggacgcgctgtttttatcaaagcttggcaagcgtatctcggcgcgcaacgtgcagaaacgctttgctgaatggggtatcaagcaggggctgaacagccatgttcacccccataagctccgtcactcctttgccacccatatgctggaatcgagcggcgatctgcgcggcgtccaggagctgctggggcacgcgaacctgtccaccacgcagatctatacccaccttgattttcaacatcttgcctcagtgtatgacgcggcgcatccgcgcgccaaacgggggaaataatgcgtttttaccgtcctttgggccacatttcggccctgacgttcgatctcgacgacaccttgtatgacaaccatccggtgatcctgcgtaccgagcaggagtcgctgaccttcgtacaaaattaccatccggcgctgaaggcgctgcaaaagagcgattttcagcagctgcgccaggcgttacgcgaaagcgagccggatatttatcacgacgtaactgaatggcggcgtcgggcagtgatgcaggcgatgctgaacgccggactgaacgcggaagaagccgatgccggcgcccgtgccgccatggaaaacttcgcccactggcgcagccgcattgatgtgccgcaggccacgcacgacgctctggcggcgctgggcaaaaagtggccgctggtggccatcaccaatggtaacgccgagcctgaacggttcggtctgggtgattactttgcgtttgtgctgcgcgccggtccgcacggccgctcgaaacccttcagcgatatgtatcagctggcggcggaaaagctcggcgtgcccgcaggggagatcctgcatgtgggcgatgacctgaccactgacgtggccggggcgatccgttatggcatgcaggcgtgctggatcaaaccgcaaggggccagcctgatgaccgccacagacagccgtttattgccgcaccttgaaatttcgcagttggcatctctgacctcgctgatataatcaccaatagttctgtataaaataccagggttttggcggatggcgctctgcttatccgccctgcgataacgcagacccggtaagcgaagcgccatcgggcaattcgttctgtttctgattactacgtggcggtgccaatggacgtttcttacctgctcgacagcctcaatgacaaacaacgtgatgcggtagccgcctcgcgcaccaatatgctggtgctggcaggcgcaggcagcggtaagacacgcgtgctggtccaccgtatcgcctggctgttgacggtagaaaactgctcgccgtactccattatggcggtgaccttcaccaacaaagcggcggcggaaatgcgccaccgtatcagccagctgatgggcaacagccagggcggcatgtgggtcgggacgttccacggcctcgcgcaccgtctgctgcgcgcgcaccatatggatgcgaatctgccgcaggatttccagatcctcgacagcgaagatcagctgcgtctgttacgtcgcctgatcaaagccatgaacctcgacgagaagcagtggccgccgcgtcaggcgatgtggtacatcaacggtcagaaagacgaaggcattcgtccgcatcatattcaaagcttcggcaacccggtggagcagacatggcagaaagtctaccaggcttaccaggaagcctgcgatcgcgcagggctggtggattttgccgaactgctgctgcgcgctcatgagctgtggctcaataagccgcacatcctcaaccactaccgcgagcgcttcaccaatattctggtggacgaattccaggataccaacaacattcagtacgcctggatccgcctgctggcaggcgataccggtaaggtgatgattgtgggcgacgatgaccagtccatctacggctggcgcggcgcgcaggtggaaaacattcagcgcttcctgaacgacttccctggcgcggaaaccattcgtcttgagcagaactaccgctctaccaacaatattctgcgtgccgccaacgccctgattgaaaacaacaacgggcgactggggaaaaagctatggactgaaggcattgatggcgatcccatctccctttactgcgccttcaacgaactcgacgaagcgcgtttcgtggtgaaccgcatcaaggcctggcaggaaagcggcggcgcgctggagcagtgcgccattctctatcgcagcaacgcccagtcgcgcgtgctggaagaggcgctcctgcaggtggggatgccgtatcgcatttacggcggcatgcgcttcttcgaacgtcaggaaatcaaagacgcgctctcttatctgcgtctgatcgccaatcgtaacgacgacgccgcctttgaacgcgtggtgaacacccccacgcgcggcataggcgaccgtacgctggacgtggtacgtcagacctcgcgcgaccggcagctgaccctgtggcaggccagccgggaattattacaggagagagcccttgcgggccgcgccgccagcgcactgcaacgctttatggagcttatcgaagcgctggcgcaggaaacctccgacatgccgttgcacgtgcaggcggatcgggtgatcaaagattccggcctgttcatcatgtatgagcaggagaaaggcgaaaaaggccaggcgcgcgtcgaaaacttagaggaactggtgacggcaacgcgccagttcagctacaacgacgaagaagaagatctgatgccgttgcaggcgtttctgtcccacgcggcgctggaagcgggcgaagggcaggcggatacctggcaggatgcggtgcaactgatgacgctgcactccgcgaaagggctggagttcccgcaggtgtttatcgtcggcgtggaagagggcatgttcccgagtcagatgtcgctggatgaaggcggccgtctggaagaggagcgccgtctggcctacgtgggcgttacccgcgccatgcaaaaactgaccatcacctatgcggaaacccgccgtctgtacggcaaagaggtttatcaccgcccgtcacgctttatcggcgagctgccggaagagtgtgtggaggaggtgcgtctgcgcgccagcatcagccgtccggtgacgcacaagcagttaggtacgcccatcacccaaagcgattccggctttaagctgggacagcgcgtgcgccatgcaaaattcggcgaaggtacggtggtgaatctggaaggcagcggcgagcacagccgtctgcaaatcgcgttccccggtcagggcatcaaatggctggtagccgcctatgcgaagctggaaacggtgtaacattcagaaaaatatcataattttgtaatattctgctagccttataccgggaaggttaattaatatcctcagccgttccgttgcgtgttgacgccatttttctgctggcgtaacatgcgcgcacgattacgctaagaggacattcgccttggacacacccagtagatgctggctcaattccctgtcatccaggaacaactcctaaggctatctcctcgcgctgatggccttagtggttgtcagcgaccgcattttttacccgtcgcactgagtcaggctgtttaatggtctgaaacccaatttgtttctgtgtgcccaccgaactgtccgataatttttgcattgggagtcccggtcatgctgagcgcatttcaactggaaaataatcgcctgactcgtctggaagcggaagagtcacaaccccttattgacgccgtttgggtggatctggtcgaaccggatgacgatgagcgacaccgcgtacagtccgaactggggcaaagcctggcgacccgccccgagctggaagacatcgaagcctcggcacgtttctttgaagatgaagacggcctgcacattcactccttcttcttttttgaagatgcggaagatcacgccggtaactccaccgtggcgttcaccattcgcgatggccgcctgtttaccctgcgtgaacgtgaactaccggctttccggttataccgtatgcgcgcccgcagccaggcgatgatcgacggcaacgcctacgaactgctgctcgatctgttcgaaaccaaaatcgaacagctggcggatgagatcgaaaacatttacagcgatctggaaaagctgagccgcgtcattatggaaggccagcagggcgatgagtacgacgaagcgctgtcggcgctggcggagcaggaagatatcggctggaaggtacggctgtgcctgatggatacccagcgcgcgctgaacttcctggtgcgcaaggcgcgcctgccgggcggtcagctggagcaggcgcgtgagatcctgcgcgatatcgaatccctgctgccgcacaatgaatccctgttccagaaagttaacttcctgatgcaggcggcgatgggctttatcaatatcgagcagaaccgtatcatcaagatcttctcggtggtgtccgtagtgttcctgccgccgacgctggtggcttccagttacggtatgaactttgagtttatgccggagctgaaatggagcttcggctatccgggggcgatcattctgatgatgctcgcgggactggcgccctatctgtacttcaagcgccgtaactggctgtagtgtttatgccggatggcgcttcgcttatccggcaaaacatcacaaccctttccgaaccctgcgctgcgtatagagcgcatccatcacaaacaccgccagcgccacccagataaacccgaaggtgaccatcttatccgcgcccggcacttcgccgtaaaacagcaccgccagcaggaacatcagcgtcggcccgatgtactggaagaagcccagcgtggacaggcgcagacgcgtcgccgcgccggtaaagcacagcagcgggattgtcgtcaccacgcccgccgccatcagcaacagattcagcgaccacgggttctgcgtcatatggctggtggcggtatcggcgatgccgaacagccagatggcggcgaccggcagcagccacagcgtttcgatcagcatgccgatttgcgcgtcaacggcgatctttttacgcaccaggccataaaacgcaaagctgaaggccaggcccagcgcgatgatcggcagcgagccaaaggtccacagctgcaccagcacgccgcaaccggcaagcagcaccgccagccactgcatacggcgaaaacgctcgccgaggaaaatcattccgagcagaatattcaccagcggattaataaaatagccgaggctggcttccagcagatgatggttattcaccgaccagataaacagcagccagttgccgccaactaacaccgccgacagagccagcagcaggatttttttcggctggctgaggagcttcttcagctgcgaccactgacggcttacgctaatcagcgccaccatgaaaaagaacgaccagataatgcggtgggtcagaatttcactggcgggaacgaaatcgatcagtttgaagtaggccggtgcgataccccaaataaaataagcggcgagggcgagtaataccccctgccgcgtctgctttgcatccatgggtacatccaacatctgttactaaaaagtaacgacattttacccgatctctgccgctcaacctaccatatacgtcgccgtggcggtggcgatatgcagctgttcttcattgtgcagttcaacgcgggcgactgacactttattaccggcgcgcagcaaagtactggaggcggtaaaacgatttccccggcccggacgcagataatcgacgcgcagatcgatagtgcccatgcgcgacaggcgctggcgaagctcatcttcgctgatcgtatcgtgacgcgttaaggtgctgccgacgcacaccagccccgcggcgacgtccagcgacgaggcgattaccccgccgtgtaaaatgctctgcgcccagttacccaccatcatcggctggttgttaaaactcagctgggcaaagtctttttcgtagcgttccagctccagtcccagcgcgcggttgaagggcatatgataaacaaaaatctcaccgaccagctgtaacgcttcatcggctgtaaggacggctgacataatcacctgatccattggttaaagaaatgttgattttatgcttcgccaatgttgatttccactttcagaaacgataactgcgcagttaattaataaatatgtagaatgggcgtctgattattattcacccctattttttgttcaggagagcaagaccgatgcggacgtttctgggttggtttctggcggccgttgcgctgccgtttacagcatttgcgcaggaagcgacggttaaagccgtgcatgacgccccggcagtgcgggggagtatcatcgccaatcttttacaagagcacgataatccttttacgttgtatccgtatgaatcgaactatgccatttacacggccaccagcgatctgaacaaagaggcaatcgaaacttacaactgggcgaaaaactcacgcaaagatgaagtgaagtttcagttgagtctggccttcccgttctggcgcgggatcatggggccgaactcggtgcttggcgcatcctatacgcagaaatcctggtggcagctctccaacagcggcgagtcatccccgttccgcgaaaccaactacgaaccccagctgttcctcggctttgccaccgactacgagctggctggctggacgctgcgcgatgtggagtttggttttaaccacgactctaacggtcgctccgatccgacatcccgtagctggaaccgtgtttatacccgcctgatggcgcagaacagtaactggctggtggaagtgaagccctggtacgtggtgggcgataccgacgacaacccggacatcaccaaatatatgggttactaccagctgaaagtgggttatcagctgggggaagctatcctgagcgcaaaagggcaatataactggaataccggttacggcggcgcagaactgggcgtgagttatccgatcacccgccatgtccgtctttatactcaggtttatagcggttacggcgaatcattaattgattacaactttaaccagacgcgtgtcggcgttggcgttatgctaaacgatctgttctaaggcattgcagtttcactcgcaggcgctgaaaatagcgcctgtttttatttcaggtaaatggggtagatgtggcgcaggcggaagtaatgaatcaggcatcgctggcgaaacaggtcttgcaggaaaccttcggctatcagcaattccgccccggtcagcaaacaatcattgataccgtgctggaaggccgcgactgtctggtcgtgatgcccaccggcggcggcaaatccctgtgctatcagatcccggcgctggtgctggaagggctgaccattgtcgtgtctcctctgatctcgctgatgaaagaccaggtggatcaactgctggcgaacggcgtggccgccgcctgtctgaactcgacacaaacccgcgagcagcagcaagaggtgatggcaggctgtcgcaacggtcaaatccgcttgctgtacatcgcccctgaacgcctgatgctggataacttccttgagcatcttgctcactggaacccggcgctggtcgccgtcgatgaagcgcactgtatttcccagtggggccacgatttccgcccggaatacgccgccctggggcagctgcgtgcgcgcttcccggcgctgccgtttatggcgctgaccgccacggctgacgacaccacccgccatgatattgtgcacctgctgggtcttaaggatccgctgatccaggtcagcagcttcgaccgcccgaacatccgctatatgctgatggaaaagttcaagcccctcgatcagctgctgcgttatgtgcaggatcagaaaggcaaatccggcattatctactgtaacagccgcgccaaagtggaagacactgccgcccgtctgcaaagccggggtttcagcgccggagcctatcatgccgggctggaaaacagcgttcgcgccgaggtccaggagaagttccagcgcgacgatctgcaaatcgtggtggcgacggtagccttcggcatgggcatcaacaagccgaacgtgcgctttgtggtgcatttcgacattccgcgcaatatcgaatcctactatcaggaaaccggtcgcgccgggcgtgacggcctgcccgctgaagccatgctgttttacgatccggccgatatgggctggctgcgtaaatgtctggaagagaaaccgcccggccagttgcaggatatcgaacgccacaagctgaacgccatgggggcgttcgcggaagcacaaacctgccgccgcctggtgctgcttaactattttggtgaaggtcgtcaggagccgtgcggcaactgcgatatttgcctcgatccgccgcgccggtacgacgggctgatggatgcgcaaaaggcgctgtcggcaatttaccgcgtcggccagcgcttcggtatgggctatgtcgtggaagtgctgcgcggcgcgaataatcagcgtatccgcgaactgggtcatgacaaacttaaaatctacggcgaagggcgcgaccatacgaccgagcactgggtcagcgtgatccgccagctgatccatcttggcgtggtgacgcaaaatatcgcccagcattcagcgttacagcttaccgaggccgcgcgtccgttcctgcgggcggaagtcccgctgcagctcgccgtaccgcgcgtggtggccattaaagcgcgtaataacccgaaagtcttcggcggcaactatgaccgcaagctgttcgccaaactgcgcaaactgcgtaaggccattgccgatgaagagaatatcccgccgtatgtagtgtttaacgatgcaacgctgattgagatggcggagcagacgccgatcaccgccagcgaaatgctgagcgttaacggcgtggggatgcgtaagctcgaacgttttggcaaagagtttatggcgctgatccgttcgcatgtcgatggcgacgatgacgagtagtcaagcacgtaaaaaagtgtcaggatgagatcctgatcatttatttccccgcgagcgagttatgttaatgctgtttttgaccgtggcgctggtgcatatcgttgcactgatgagcccgggaccggatttcttttttgtttcacagactgccgttagccgttcacgtaaagaagccatgatgggcgtgctgggcatcaccacgggcgtgatggtctgggcgggcgtggcgctgcttggcctgcacctgatcctcgaaaaaatggcgtggctgcataacattattatggtcggcggcgggctgtatctgtgctggatgggttaccagttgttgcgcggggcgctgaaaaagcaggacagcagcgcaccgacgccgcaggtggaactggcgaccagcggacgtagtttcctgaaaggtctgctgactaatctggcgaatcccaaggcgattatttacttcggttcggtgttctcgctgtttgtcggcgataacgtcggctccgcggaacgctggggcattttcgtactgatctcgctggaaaccttcgcctggttcaccgtcgtggcgagcctgttcgcgctgccgtcgatgcgtcgcggttatcagcggatggcgaaatggatcgatggcgttgccggcgcgctgttcgcgggcttcggcattcatctgattatttcccgctaacttttccccacccggcataaaagacgggtgggtgatttttagtggcaaaggtgctgcaactcgtcctgcgtcaggccggtcatatccataatcgcgtctttgtcgaagcccttttgcagcatctgtcgcgcaatctcctgtcgagcagcgcgttgtccttcgaggatcccttgttgtagtccttgctgtatcccttgctgtagtccttcccgaattccttcctgtattccctcttgtatcccttgcaggagtccttctgtccgccccatcaattttaactgttcagcgattgtcatcagcttgtctccttgttgtggcacgcggcgcgccagttcatacaataacgttttcacgtcatgcgtttctcctgcctgaatcatatattttatcagtaccgcaatttgttgtccgctcatgtgcttttcccgcagcaggttggcgagtctgtctagcagcagggctatatcacgctggcggatatgcttctggatcagggtcagcgccgccatgctgcgatgttgcatgatttcctcatcggggatcaccgtaatgtccaccagcgggaatgggctactgtagagctgccgggccagctgcggctgttgaaagtcgtccagccagttcaggctccagggccaggggctgcgtcgcccctgatagaaaagcaccgggatcaccagtggcagagtggaatgcccggcctccaggtggcgctgcatggcggccaccgcgtagcgcatcaaccggaatgccatatgtttatcgggcgagctttggtgctcgataagcacatagatatagccatcaccactggtcgtctttagcgaataaagaatatcgctgtagtagggatgcaaatcgtcttcgacaaaactgccggattccaggcgcagcgtatccagatcgcagagcgttctcaggtctggcggcaggtgaatgtcaataaaatcccgcgcggtttccacgcgggagaggaaggttttgaataccgaatcatggggtgtcgcagcttgcgccatgttatgccgtccgtggtgacttcaatggcggcattctggcactgcgacaaaacaaaatttgcgagccgctttcccgatttacttacgcatgacgggtggaggccagcagcgcgcccaccagcacaaacagcgatccaaagatccggttgagcgctttcatctggcgcgggcctttgatccatgacgcaatccgcgtcgccagcgtggcgtatccaatcatcacaataatatccaccacgatggtggtggtgccgagcaccacgtactgcatgatttgcggctgatgcggcacgataaactgcgggaagagcgcggcaagaaacacaatgcttttggggttggtaaggttcacaaacaccgcccggcggaacagatgcccacgcgactgggtgctcgccagcgtattgagatccagtgcccccgccgcgcgccactgctgaatacccagccataccagataggccgcgcccgcccacttcagcacttcaaaggccattacagaacgggagaacagcgtacccagaccaatacccaccagcacgatatgaatggcaagtccggtctgcagaccgctgatggaggccgccgcgccgcgatagccgtgcgtcatggcggtagtcatggtgttgatcgccccggagcccggcgacaggctgaggataattgacgtgatgaggtaagcgaaccaccattcgaaggtcatgtgaaactccctggatgacattttttatgccacaataccttggtgtttgggtacggtgtagcgcggcctgaaaaaacgataatacacggcagtcgggggttcagacccaatgtttcggcagaaaatggactgggaaacaagagaaaacgcgtatgcggccttcactcacggaccgctgaccgatttctggcgtcagcgcgaggaagccgaaatcatcggcgtcgataatatcccgatccgctttgtgcgctttcgcgcgctcggccacgatcgggtgattgtcgtctgccccggacgcatcgaaagctacgtgaagtatgccgaagtggcgtacgatctgtttcatctcggttttgacgtattgatcatcgatcaccgcgggcaggggcgctccgggcgtctgctttccgacagccatcgcggtcacgtcgataattttgatgattacgtcgacgatctggcggctttctgggcgcaggaagtgacgccaggcccgtggcgcaaacgctacattctggggcattccatgggcggcgcgatctccacgctgtttctgcaacgcacgccgcaggcctgtgatgccatcgccctgaccgcgccgatgtttggcattgttatccgtctgccggactggatggtgcgacacattcttgactgggccgaaggcaacccgcgtatgcgcgaaagctacgccatcggcaccggacgctggcagccgctgccctacagcctcaacgtgctgacccacagccgggaacgctaccggcgcaacttgcgcttttatgctgacgatccgcagctgcgcgtcggcgggccaacgaatcactgggtacgggaaggaatacgcgcgggcgagatggtgctggaaggcgccgccaacgacgccacgcccatgctgcttatccaggcagaagaagagcgggtagtggataaccgcatgcacgatcgttattgtgaaattcgcgccgcagcgggccatccctgtgaaggaggcaaaccgctggtcattaatggcgcttaccatgagatcctttttgaaaaggacgctatgcgctcagtcgcgcttaacgccatcgtcgattttttcgacaggcataactcacccggcgggtctcccgctttgtccagaggttgaattttcttatgtatcaggttgttgcgtctgatttagatggcacgctgctctcgcccgaccataccctttccccttatgcgaaagagacgttaaagctgctgaccgcgcggggcgttaactttgtcttcgccactggccgtcaccacgtcgacgtgggccagatccgcgataatctcggcatcaaagcctatatgatcacctccaacggtgcgcgtgtgcatgataccgatggcaatctggtcttcactcataacctggatcgcgatattgccagcgacctgtttggcgtggtgcatgcgaacccggatattctcaccaacgtctaccgtgacgacgaatggtttattaaccgtcatcgtcccgatgaaatgcgctttttcaaagaggcggttttcagctattccctctttgagccaggcctgctggacgccgacaacgtcagcaaaattttcttcagctgcgaaagccatgaaaagctgctgccgctggagcaggcgatcaacgcccgctggggcgatcgcgttaacgtgagtttttccacgctcacctgtctggaagtgatggcgggcggcgtctcgaaaggccacgcgctggaagcggtatccaaagcgatgggctatggcttagcggattgcatcgcctttggcgacggcatgaacgacgcggaaatgctctcgatggccggtaaaggctgcattatggctaacgcccaccagcggctgaaagatctgcatccggagctggaagtgatcggcaccaacgccgacaacgctgtgcccaattacctgcgcaagttgtttctcgattgattaaatagcaatcagttgtcaaccatgaagtccgctacaatgaatgctcattaatcaaagagacattcattgtggcgttactgatcatcaccaccgttctgtgggcgttttccttcagcctgtttggcgaataccttgccggtcacgttgacagctatttcgccgtgctggtgcgcgtcggcctcgcggcgctggtctttttaccttttctgcgcacccgcgggcacgatctgaaaaccattgcgctctatatgctggtgggcgccatgcagctcggcatcatgtatatgctgagcttccatgcttatctgtacctgacggtttcggaactgctgctgttcaccgtgctcacgccgctgtacatcaccctgatttatgatctgatgagcaagcgccgcctgcgctggggctatgcatttagcgccctgctggcggtgattggcgcagggatcatccgttacgatcaggtcaccgatcacttctggatgggcctgctgctggtgcagctgtcaaacatcagctttgcgctgggaatggtgggctataaacgcctgatggaaacccgtccaatgccgcagcataacgcctttgcctggttctatatgggcgcgttcgtggtggcggcgatcgcctggtttatgatgggcaacgcgcagaaattaccggaaaccacgctgcaatggggcattctggtgtttcttggcgtggcagcctccggcattggctacttcatgtggaactatggcgccacacaggtggatgcgggcacgctgggcatcatgaacaatatgcatgtgcccgccggtctgctggttaacctggcgatctggcatcagcagccgcactggcccagctttattattggtgggtcggtgatagtggcttcgctgtgggtgcatcgccggtgggtcgctccgcgctccgcacaaaaggaagatgatcgcaggcatggttccgcgctgagcgaataaaggcttccgttaccggctgacgctgctcgccatcgcgcacggcggcgtacagccggctccacaatccctcgcccagggttttggtcacgatcaggccctggcgctcaaaactctccaccacccagtgcggcagcgccgcgatgcccatttttgccgccaccatctggatcagcagcagcgtgttatcgacgcttttcagcgccggggtgatgcctgccggttgcaggaaatgccgccagatatccagccggctgcgctgcaccggataaatcagcagcgtttcgcaggctaaatcttccggcgtaatacgcgcttttgccgccagcggatgatccggggccagcaccagccgcacttcaaaatcaaacatcggtgaatagtgcagaccgctgcgcggcagaatatcggaggtcagcaccacgtccagttccccctgttgcagcgcgggctggggatcgaaggtcacgccggatttgaaatccatctccacctgcggccatttcgcgcggaaattttccagcgccggggtcagccactgaatgcagctgtggcattcaatggcaatgcgcagcgtcgtttgctgcggctcgttgcagtcctgaagcgcccggctgatttgcggcagtacctgattcgccagctgtaacaggatctcgccctgcggcgtaaagcgcagcggctgactcttacgcacaaataaccgaaagccaaggcgctgctccagatcgctgaactggtgggagagggcggattgcgtctgatgcagcgtggctgccgccgccgccagcgatccgctattccgtaacgcctgtagcgttttcagatgtttaatctcgatcatgaaagtccttcactccggcatgaacaatttgcgcttgaggaatatacagtaactgccaattatagatgtgtaaacatctggacggctaaaaatccaatgtcttttaaatttatggtgcgttggctgcgttcactcaccccggtcacttactgatgtaagctcccggggatgagcaaacttgccgccttccctaaattcaaaatccacaggatttataattcattagaggaagaaattatgacaattcgcaaccacaccctcggtttccctcgcgttggcctgcgtcgcgagctgaaaaaagcgcaagaaagctactgggcgggtaacaccagccgtgaagaattactggcggtggggcgcgaactgcgcgcccgtcactgggatcaacaaaaacaggcgggtatcgatctgctgccggtgggcgatttcgcctggtacgaccatgttctgaccaccagcctgctgctcggcaacgtgccggctcgtcatcagaacaacgatggatccgtcgacatcgacaccctgttccgcattggccgtggccgtgcgccgaccggcgaaccggctgcggccgcagaaatgaccaaatggtttaacaccaactatcactacatggtgccggaattcaccaaaggccagcagttcaaactcacctggacgcagctgctggaagaggtggatgaagcgctggcattgggccataacgtcaaacctgtgctgctggggccggtgacgtacctgtggctcggcaaagtgaaaggcgagcagtttgatcgtctgagcctgctggacgatattctgccggtctatcagcaggtgctgggcgagctggcgaaacgcggcgttgagtgggtgcagattgacgaaccggcgctggtgctggagctgccgcaggcgtggctggacgcctttaaaccggcctacgatgcgctcaccggacaggtcaaactgctgctgaccacctattttgaaggcgtgacgcctaacctcgacaccatcaccgcgctgcctgtgcaggggctgcatgtggatctggtacacggcaaggatgacgtcaatgaactgcatcgccgtctgccgtccgactggctgctgtccgccggtttaattaatggccgtaacgtctggcgtgccgatctgacagagaaatacgcgcagatccagccgattgtcggtaaacgcgatctgtgggtggcgtcgtcctgctcgctgctgcacagcccgatcgatctctcggtggaaacccgccttgatgcggaagttaaaagctggttcgcctttgcgctgcaaaaatgtgaagaactggcgctgctgcgcgatgcgctgaacagcggcgatacggtaaaactgacagaatggagcgccccgatccaggcgcgtcgcagttcagcgcgggtacataaccccgccgtggagcagcgtctggcggccatcaccccgcaggacagccagcgccagagtgcttatgcagaacgcgcaaaagcccagcgtgaacgcttcaacctgccggcgtggccgacaacgaccatcggctccttcccgcagaccaccgagatccgcggcctgcgtctggatttcaaacagggacgtttggacgcgggcaattaccgcaccggcatcgccggacatatcaaacaggcgattgccgaacaggaacgcttagggctggatgtgctggtgcacggcgaagccgagcgtaacgacatggtggaatactttggcgaacacctcgacggcttcgtattcacgcaaaacggctgggtgcagagctatggctcccgctgcgtaaaaccgccagtggtgattggcgacgtcagccgcccggaagccatcaccgtggagtgggcgaagtacgcccagtcgctgactgacaaaccggtaaaaggcatgctgaccggcccggtgaccattctctgctggtccttcccgcgtgaagacgtcagccgtgaaactatcgctaaacagatcgccctggcgctgcgtgatgaagtggcggatctggaagcggcgggcattggcatcattcagattgacgaaccggccctgcgcgaaggtttaccgctgcgccgcagcgactgggctgactacctggcatggggcgtcgaagccttccggattaacgccgccgtggtacgcgatgacacacagatccacacccacatgtgttactgcgagtttaacgacatcatggattccattgccgcgctggacgccgacgtgatcaccatcgaaacctcgcgttctgacatggagctgctggagtcctttgaagagttcgagtacccgaacgaaatcgggccgggcgtgtatgacattcactcgccgaacgtgccgagcgtggagtggatcgaagcgctgctgaaaaaggcggcgcagcgtgtaccggcggagcgtttatgggtgaacccggactgcggcctgaaaacccgcggctggccggagacccgcagcgcactggcgaacatggtgaaagcagcgcagaacctgcgcacggcgtgagtatattcccctctcctgaacaggagaggggcaaatttattacagcgactgatctttcgtttcgtgcgtaaggatcagcgcgattaacgtcagaccggccatcgcggccagatagatgccgacatagaacaggccataattggcggtcagccaggcggcgatatacggggccacagacgcgccgagaattgacgacacgttataggagaacgacgcgccggtataacgtacttccgtcgggaacagctccggcagcagcgcgcccatcgggccaaaggtcaggcccatcagactcagacccagcagcagatacaccattaccagcgcctggcttccggaacccagcagcggcgggaaggcaaacagcgcaaaaataatgatcatcgaggtaatggcaatcattgatttacggcgaccataagcatcagccagcagaccggctaccggcaccattacgccaaaaccaattaccgccagcatcagcatccacagcacttcattacgcggcatccccagtcccacaggcgcaggcgtggtgctgtaggtcattgagtaaaccgtcatgatgtaaaacagcgtataggtcgccagcatgatgaaggtgccgagaatggtgacgcgcagatgtttcgtcagcagcgtacccagcgggatcttcacctgttttttcgccgcggcgactttagcaaacaccggcgactcatgcagcgacacgcgcacgtacagaccgatgagcaccagcacggcagagaaaatgaagggtacgcgccagccccagctcatgaactgctcgtcggtcagcagccaggagagcagcaggaaggtgccgttggcaaagaagaagccaatgggcgcgccgagctgcgggaaggagccgtacagggcgcgtttacgcggcggcgcattttctgtcgccagcaacgccgcgccaccccactcaccgccaaggcccaggccctgaccaaaacgcgccagcgccagcagcagcggggcgaaaatgccgatggtttcatagcccggcagcaggccgatcagcaccgtggaaatccccatcgtcagcagtgacgccaccagcgtggttttacgtcccacgcgatcgccaaagtgaccaaataccgccgagccaatcggacgggcgataaaggcgatggcgaaagtggccagcgactgtagcgtggccgctgtcggatcgccctgcgggaagaagatatgtggaaagacgataaccgccgcggtggcataaatataaaaatcgaaaaactcgatggcggtgccaatcagggaggcaacaacgaccttattgcgtgagtttaccggcgggctttcctgctcattgtcgagggttgtggctgtagcttgcatagatatttcttattttatggcgaacggacggccatattacgcacagcaaaagcgacatttcaatccgttacaaagcagcgaggcggcgattaattgcgcaaaaagtgaataattttcatgcctgagatttggcatccatgaaatgcttcacacttttttaatatcagaatataaaactggttttcggttaaataaaagttacggactggataataatgctgaaatgatgaatcgggctgaaattttgcgtttttattcagcccgataataggtttagcggtgttttcttcccggcattcgcgggtcgtctttgtattctgcggtggcgatccaggcggcgcagaacagcgtcagacgggcgaagaagtagaagaacgccatgataccgagcaccgaaccaaaggccgcgccggacggcgactgcaccagtgaaggcagggtataggtcatgataattttaatcacttcaaagccaatggcggcaataagcgtcccgcgcatcagcgcccgcttacgcggtctgtggcgcggcagtcgccagaagatccagaagaacagcagatagttggcgcagatggaaatcgccagaccaatcagccgccaggccggtttcagccactcgatagaatccagatagagcgccgaaatgatcatctcctgcgctgcgccggaaatggacgtgatggaaagcgtaatgatcagcgccaccagcaggccaatcagcgagacaaaatcgcgcagatatttcacccagaacttttcatcgtcctgggcgttacgctcccagacgtcacgcgactgggcgcggatcgcttcgcgcaggttgcccatccagttaacaccggagtagagcgccacccccaaccccaccaggcctaccgttgtacgctgttgcacggcaatgttgatggtatttttcagcgtggaagccagcgtcggatcgctgacgttggtgaggatcttattaaaaatatcctgcagcagcgtcgggttcgacaccagcacaaagcccgctgccgcgaaggagaccatcagaatggggatcatcgacaggaacgaaaagtaggtgatagcagcaccaaactgattgcccatgcggtcattaaagcgttcggtggcgcggatcaggtgcgccaccatcgggcgtcgctggatcttttccgcggtctccttcaccgtttcgatggcaccgccgccctcaccttttttttcaggctccggttccggcttatccgtggtgtccattttttttaccggctcgtagtccaggtcctgagtcggtcgtttctcgctattttccgctgtcatcagagctgtgttccttcgttgttagcgtgatgtaacagaaattatagacggtcattggtcaacgtaagctttcatcacgtcagtcagccattccatgaacagatgcacccggcgcgacaggttgcggcgatgcggataaatcagcgataccggcatcggctgcgcgcgatactgcggcaggatttccaccagtttgcggctgcgcagcgcctcccgcacgccaatgcgcggcacctgaataatccccagccccgccaggcaggcggcatgataggtttcggtactgttgaccgtcaggatgccgccggttttgatccactgcgtggcattgtcgcgatatacctcaaagccctgcgggcgcgtaccgaggttaaccgcatagtgcaccaccgcatggccgctcagatcctccagggtttccgggtagccaaatcgcgcgaggtaatcggggctggcgcagttgatcaccgacagcttgcccagcggacgggcaatcaaccccgaatctttcagcgtgccgacgcgcaccacgcagtcgaagccttcgcggatcacatccaccagccggtcgctgctgctcagttcaatttcaaggccgggatactgctgtacaaaggtggacaggcgcggaatgaccaggttttttgccactgcgaccggcatatccacgcgcagtcgtccgctgagggtggaaggatcgtgcaaaaataaaccatcgagctcatcgaggttaataagtaaatccttagcccgttcgtaatagaccatgccgtcctgggtgagctgtacccgccgggtggtacgatgcagcaactgcgtgcccagatggttctccagcgcctgtatctggcgggagacgctgcctttcggcagacccagcgactccgccgcacgggtaaaactttccagttcggccacccgaatgaacagctgcattgcgtaaactttatccatcgccgcgccctattgttgttgtaaatgaaacagtgaagcgtaccgggacatctttattgattttctatcacctaataagctgcttctcaatcaccacaccccctgaaatgaggtttcttatgacacaacctatcgcaatagtgaccggcggcagccgtggcctcggtaaaaacgctgcgctgaagctggcggcaaagggaacagatttgatcctgacgtatcacagcaatgcgcaagcagccgcggcagtggtcggggaaattgagcgcgcgggcgcgaaggccgtggccttgcagctggatgtcagtgatgtcagccagttcgccggatttgctgaacaggtgcggcaactgctaaaagacgtctggcaacgtgacaacttcgactatttattaaacaacgccggcgtgggtctgtacgccccttacgcggataccagcgaagcgcagtttgatgagatgatgaatattcatctgaaagggccgtttttcctgacccagcgcctgctgccgctgatgaaggacggcggccgcatcctgaacgtctcctccgggctggcgcgctttgctctgccaggctccagcacttacgccgccatgaagggcgcgatggaagtgctgacccgttatcaggcgaaagagctgggcgcacgcggtatcaccgcaaacattattgcgccgggggcgattgaaacggactttggcggggggcgagtgcgggatgacgcgcagatgaaccggtttgtcgcctcgcaaaccgcgctgggtcgcgttggactaccggatgatattggcgacgccatcgccgcgctgctcagcgacgaacttcgctggatgaacgcgcagcgtattgaagtatcgggcggaatgtttttgtaagtgtcaaaacaaacgggggcagcgcccccgttcggttattctttttgcagacgtgaaacttttatccgcggcggggtttgctgcttgtccagcgaaccggaaatactgatcagctgatccgggctgacttctctttctgtaaataccgccatgggaatataagcgtctatctggccggttttatcgcggaaggtataaatatcgttaccttttttcgcgatcaggttaccgcgcagggtcacagaggcatcgtcgtgcatctctgtaacatggtcgacggtcattgagtgggcttcttcagcgccgcggtagccgtcattgagcttgtgcgccggtcgcggcgcttcatccgtattcaggccgggcttatcgtcggcaagcgccggaagggcaaataacgccgctaccgtggcggctacaatcatttttctcatgctgactccttaaattttgcctcgctatcctgttaagcctggcataaggatcagcattatgaagggcgaatcgtctggatcagcggtattcatggcgcagcaaaccgaaaagccagtcattttgccactgcccgttcagccagaacgcttcgcgcagttcaccttccagtatgaaccccgttttatccagtaatccctttgatggcgtattcccggcagtgaccgtggcgataagccgacgaatgccgccctgctgaaaagcgtagtcgcacactgcccgcagggattcgccgccaaagcctttgccctgcgcctgcggcacaaacaggaagcccacttcagcgcagtccgcttcatggtgcacataaccggtaacgcccagcggctgccccgtggcgcgctcaaataccatcagacagagccagtgcgcgctgcccggcgtccatggcggcaggcggctctcgaatgccgcgtggatctcctcctgcggacgcgggtcagagacaaaacgcatgatctgcgcatcctcatacagcgcgaggaaaaacggccagtccgttgactggatctgtcggcaccagaggcgttccgtggtcagctcaagcatatttcgcttccatatctgtgcagccgtcactgatattcctgtataactggtctatcgtataagtggctggaaaaaaagaaaaaataaagaaaaatgcccacaaaattaacgtcggctggttgcacttaaaggaaaataaagatgcgcaattcaacgtctggcattcgcgaacagtttgaacactgtatcggcatcattcgtcaggcctccaccgaaattttatcactgcttgatattgatgtgaccgagggcaaagatccacgctggtttctggaacagctggacgccgcccgggcgaatcttggcggctgggcggcggtcgctcaccggctgcggctgaacgatgcggaactgtcgcagttcaccctgttgttgcgccatctgcaacagcgggtgccgcagtatgaaagcgggcaggaggtcagtgaaaaccagctgatcacggcgctgcgctttatgacctcccttgaactgctgcgggaaaaacagccgcagctcacctacagcaccgaaatcactgtgctggatgagacgcagcaacagcagcaggcgctggcgcagttacgggcgattgagctgatgatcaaagcgctgatctacgaagcctggcccgacagtatccagctcagtaaccatctgaaaacgcagttcggcgtcgatcgcgtgcggcgctggctgaagctgggcgagcgtaacgacgtgttaagcggcatgttattcagcgagctggcgctgatgctggtggataaaaaagagttcacccagcgctactcggcactgtttaacgatccgcatacgctgatgctgtttgccgagccgcgcaaaacgctccaggtctttctggatgacatccggcagatccgcaataccctgatctcccaggatttgctctccccggcgcagctgcgtttactggacagctactacccgcagatcaccagttccgtgcagaacgccttcagagaagggcgcacccgtatcagcccggatctgttactggcggcagacgcggttgagctgcaatctttctgggagcgggcgcgtaaaaaagcgcgcgctaccggcggtgatatttttgaggttcgtgacagtattgaacgaccagggcagcgcgcgccacgcaccccggagcagcgggaacaactggtatcgggggtgctgtggggcgcggtaggcgtgatggtgctcggcatcatgggcagcgggctgtggttgttcagcggtggcggcaatcccccacaaactgcgcaggccgcccagacagaagtgcagcaggagcagagcgagccgctacgcgaaaaaccctcgtcgcgggagaatctgacccgtatgggcattacctgggacgaaaataatctgcgtgcggccattaaccgtaacgattcgcgggtggtgcagctgttcttgcagggtggtatggactggaagctgtcgtggacggaagaggcgatgtcagcaggtcacgatgatgtactggaactgctgctgcgctatcgcctgcaaatggtggaactgaaaccctgccgacgctttatcagcaccctgagccatgccatggtcaccggcgaaaagctcacctcaatgcgcaaagcttatctgcgggcattctgtacgacgcctgcggtggtgaagcgtcagcaatatgaaatggatcaggcgaagcgcagagctctcgcagagccggacgcccgcaccaaaaaatggctggcgatccagacatcgatttatgaggtgattgactaaccgctgtatgcccggcagcgcgtcgctgccgggtagcgatcagggttcgccgtacagaccaatcagacgccgtaccacgccgttcgtccagccaaagccgtcctgcaacggatattcaccgccgcccccttcgcgcggggtaccgcctgcgatgtggtacttctcaatcagcttatggtgacgctggtaaaacagatttaccgtttccagccagctgtgggcgatctcatctccgagcgcatcattaccgtagagtttaaagccctggatcgccatccattgcagcggagcccagccgttcggtttgtcccactgctcgccggtttcatattcagtcgccatcacgccgcctggcgtcagcagacgttcacgcaccgctacggccagccggtcggcctgttcatgcgttgccataccgacatagagcggaacaagactggcggcggaaaacagcgccatttcgccgcgtcgccagtcgtaatcgcggtaacagcctttctcgtcgtcccacagatagcggttgaccgccgcacggcgatcgctcgcccgctggcggaacatcgcttcgccttcccggtcgcctttcacgccggaaatattggcaatggtgctttccagtttgaacaggaaagcgttcaaatcgatagggataaattgtgtggtgcggatactggcgaggcggttcgcatcgcgcagccagcgggaagaataatcccagccggacgccgcgcccgcgcgcagatcgcggtacacttcgctggccggacgcccggaatgacgggcagtttccacgtcctccagccaggattcatcgcgcggcgtatcacggtcatcccagtaacggttgagcagcgatccgtccggcatacgcaccgcagaacggtacgcctggtttggcaccagcgattccgcgccgtccatccagaagctgtactccatcagcagatgttccagatagcgacgcgcgccgcgcacgccgtcttcctcaaacagttccaccatcagcgcaaagaccggcggctgggaacggctgaggtagtaagtccggttaccgttcgggatatgaccgtaacgttcgatcatccacgcaaaattgtccgccatgcatttcagcaggtcgttacgcccactctcggcgaggccgagcatggtgaaataggagtcccagtaataggtttcgctaaagcggccgcccggcacgatataggcctgcggcagcgccagcagcgatgaccacgggatatgatcctgcggctcgcgggtcagtatcggccagagctggtcgatgtgttctttcagcgagtttttgggatcggagacgtattcgctgccgtactgttccggcaaccagaaatgcgccatgacgaacttttgcagatcaaaatcagggcggcgtttgatacggcgataacggatcagaatatcaaggggatccattttcggcgcacagtcgggaaaagttttgctgtcggcaaacagtcgggtggactgcacgtgttcaaacagttccagatagcgatcggcaggcgtcagcgcatcggaggcggggtagccttcgatcatttccggttccggttccgcctcaagcatttccgcaagcttgagctcgtacggatcggtgtcaaagctggttttttcttcgatcacgaattcaacggattcatctggtttgagtttctggttgaacatagtgatgctgacctccggatggcgtcgtaaaaagatacgggtgttgcccggctacttataagcgtagacagtctttttacccgttgagttgcatactgtgcggtagatcacatttcttcacgcctcgtctggcgcgggaaaataataaatcgctgtttgcactactgatttcccgaatgcacgaacggcgactgcccccacaattcagagcaatcgctttgcaacacgatatgaatgttttccggcaattagccgatgacatgccccactttaacaaacagaacaatcagcgccgtcgccagcacgacgatccatggcgtataacgaataaacgggcgcaaaggcttattttgtccttccgccagacgtcgcagggtggcagagagcatgccatgcagaccggagagcaccaccagcacgacaattttaaggatcagccagaggggcaagccgccgccatgactgacaatcatcgccagcccgcaggcccagaggatcagcatcgcaggagacgtcacgctgcggctccagcggcgaacctgggcgagcagcgaaatatagttgctggtattgcccgcgccacaggccacgaccaccaccgccatcatcaataaaccgccgagccagaccatccctgtaatcagatgaatgacgtttaaccactggtgagccatgtttaatccttagaaaataagcgtgcgtgcggataagcgtactctctaaatggattaaagttgagtatgttcttataaaaaaaaccggcacgatggccggtcttcagggggcggtgttaaacgtccgttacagcgtctgtaaaaaggccagcagatcggcattcagctcgtcggtatgggtgacggcaaaaccgtgcggcgcgttgtcgtaaaccttcagtttagcgccgacgatcatttccgccgccactttaccggtgctttcaaacggtaccacctggtcattgctgccgtggatcaccagcgtcggcacgtcaattttcgccatatccgggcggaagtcggtttctgagaaagcggttacgcagtcaatggtgcctttcagcgaggccagcagcgcaatgttcagcgtctgggtcagtacgccttcggagacggtctgcccggcattggtgccatagaacggcgtggcgaaatcgctgatgaactgcgcgcgatccttacgcagcccctgacggatgccttcgaagacagacatatcgacgcccgccggataatccgcggttttaccgaagatcggggtcactgcgcccagcagcaccagacccgccacgcgcgaggtgccgtagttgttgatgtagcgcgtcacgtcgccgccgcccatggagaagcccaccagcgtcacctgttgcagatccagatgggtgatcagatcgttaatgtctgacgcgaaggtgtcgtagttgtagccattccacggctgatcggagcggccaaagccacgacggtcaaaggcgataacccggtagccgttctcggcgaggaaattgagctggctgtcccacatatcgccatccagcggccagccgtggctgaacagtaccggcttacccgtgccccagtctttgaaatagatctgcgtaccatcctgcgtcttaaatgtgctcatgctttacctcgttgattaatatgcatttaacaagtcgagccttattctggcgcgataagataacgaacttccggaagatcggacccctgatggaatcctagcacccgattctgaattttcttgtcgttcatggtgtagcgctcccgctgacgcaaatgctccatccaggatccgacgacaaaggtttccacgaaaatacccggttgcaggatgtcttcgtaaatcgcccagttcagcgcgccgccgcgtcgcctgacgcgacgcatatcctgcatacacaccacaaaatcatgggcgctttgcgggctgaccaggtagtgatagctcaccatgaccgggccgcgatcgtggcggatctcaagctccggcgcggcttcgttaatggcgctcagatcgagattcagatccggatcctgatccagccgccagcgcagcacggtggcgctggccagcaacatgcccgccgtcgccacacagagggaaaacggaatgctgaactgcgaggcgagctggccccagagggcgctgcctgcggtcatcgaaccgaagaacaccgtcaggtagaccgccagcgcgcgggctttcacccatttggcggcgctgcgttgcgcccccagattgagcgtcgacagcacggcaatccacgcgaagccggtaaagaattcaaaggcgttcagcagccagaagtggcggacaaaggccagcgccagcatcgtcacggcaaacatcacgctcgccagcaccatcaattggtccgggttgaagcgtttgcgcatgcgtggcagcagcagcgcgccgcataccgcgcccacgccgatgcagccaagcataatgccgtaaccgcccggccccagccccagttcccgacgcgccaccagcggcagtaatgcccagcccgcgctgccgaaaacaaagaaggcgacggtgcgcactaatacgttacgcagcaccggcgcggcatgcacatagcgcacccccgcccgtaccgccgggaagaagtgctccggcggcagacgctgcacattcggctgcgccttccacacatacagtacccagaagacgccgagcaccgacagggcgttcagcaggaacaccatccacggccccgcaaaggagagcaccaggccgccgagcgccgggccgatggcgcggctgatattgatccccagcgaattgagcgcaatggccgatcccagctcttcttttttcaccagatccggcactatggcctggaacggcggcgagctcatggccgcgccggtgctgagcaggaaggcggcgatcagcaggacgcccggcgtgaccatatccgcccatgacataaacgtcaggcctgcggcggcgataaacacccagatttgcgagaacagcaggtatttacgccgatcgacgatatccgccatcacccctgagggcagcgcaaagaggaacatcggcaggctactggcggcctgcaccatggcgacggagagcggatcggcgctcagcgtcagcatggtccagttgatgccgacatcgttcatccatgagccgacattcgacaccacggtggcgatccacagcatgcggaacacacgctggcgcagcggctgccacggggaaaccgccgccgtgaccggcggcagatccgctttaggcatatcgtggatgtcattaacctgcgccacgggacacctccgtaatgccgcctgacgccatgcgccagcggccagggccggtcagcgccagggtgccgaagatgatcagcagcagccagccgaactgcccttcggcaattgaccagtcggcatgtaccaccagcatcgccaccagcagcacgccaataatcggcaggcaggcgaggcgggtaaacacaccggcaatgataaacagcgggcagatcacctcggcaataatcgccgggatcaggctcatgtacggccccatgccgaaaggatcttcaatacgtgtcagctcctcgctgaagtgaaaaatcttcggtaagccatggacatacaacagtagcaggctgcccgccagacgcaggaacaatagccccatatcaatacggggcggattaacgttcagtgaatttttcatggcatcagaacgcaaagcagctgcaaccgagcgcgccccagaaggcgttattttcggcaaccggtacgtttgaaccccgcgcaatatcatgggagtgactatgtacgccgcacggcccgctgcactggtgcggcatctgctgcattccgacgcgggtttgggcgttcggcggcgcgctgcggtagtggccagggacgttcaccaccggcgaccattccggcagaaccgggatagacggcggcgcttctgcactgaaggatccggcggcatagacaatattgccatcaacaatggtcagcacggattcaatgcctttgatctcttcttccggtacggcgaaatagtctttgctcagcaccaccatatccgccagctgccccactttgatctggccttttttgccctgctcgctggagaaccaggcgctgccctgcgtccagagcatcagcgccgtttcacgatcgagacgggcgttaacgtcatacatctgcatgccgccgacggtacggccggaaaccagccagtagagcgcggtccacgggttatagctggcaacgcgggtggcgtcggtacccagaccgaccggcacgccggtttccagcatacgggcgaccggcggggtgtggcgggtggcttcgatgccgtagcgctcggcaaagtattcgccctggaacgccatgcggtgctgcacggcgatgccgccgcccagttctttaatacggtcgatattacgctgggtcacggtttccgcgtggtcaaagaaccagtgcaggccgttgaacggaatgtcgcggttcactttctcaaacacgtccagcatacggctgatggactcatcgtaagtggcgtgcaggcggaacggccagcgatgctccaccagatggcgcaccacgcgctccagctcatcttccatgcccggcgccagatccggacgcggctcgaggaaatcttcaaagtcggcggcagagaagaccagcatttcacccgccccgttatgacggaaatagtcgctgccctggcccggcgtcagcatgtcggtccatttttcgaagtcttccagctcatgtccgggacgctgggtaaagaggttgtaggcgatacgaatggtcatctgcttcttctcatgcagctcggcgatgacttcgtaatcttccgggtagttctggaaaccgccgcccgcgtcaatggcgctggtcaggccgaggcgattcagctcgcgcataaactggcgggtggagttcacctgctgctccagcggcagtttcggccctttcgccagggtggcgtagagcatcatggcgttcggacgggcaatcagcatcccggtcgggttgccgttgctgtcgcgctggatctcgccgcccggcgggttcggggtatctttggtgtaacccaccactttcagcgcggcgcggttgagcagggcgcgatcgtaaaggtgcagcacaaacaccggtgtgtccggcgcggcctcgttgatttcatccagcgtcggcatacggcgctcggcgaactggaattcgctccagccgcccaccacgcgcacccactgcgggtttggcgtgcgcagcgcctgctctttcagcatgcgcagcgcgtctgccaccgacggcacgccttcccagcgcagttcgaggttgtagttcaggccgccgcggatcaggtgcaggtgcgaatcgttaaggcccggaatggcggtgtgacctttcaggtcgatcactttggtggcctcgcagtgatactgcatcacctcattaagcgtaccggcttcaataaacttgccatcgcgaatggcgaccgcttccgccagcggattctcgcgatcgacagtatgaaacttaccattcgtcagaatgatgtcggctttaccgagggtaaccatagaacctccagaatgaagatgtccgtaaaaaaggtatgtgaaccgtggacaataaaatgcctgagcagtagcgcagggggagaatggcgggattatggtcaggcgggataaaaagcgtctagttatacgaaggtatagttatacgcagagacaataggcgggaaatcaaaaggttcttacactgcgccccgacagagacacttaacaattaacctcaatgggcgacatcatgaacaacagcaaacttgaattactgaccccgcataactgccagatgatctttatcgaccaccagccgcagatggcatttggtgtgcagtccatagatcgtcaggtactgaagaacaacaccgtggcgctggcaaaagcggcgaaagtgttcaacattcccaccatcatcaccactgtggaaacagaaagcttctccgggaacacttatccggaactgctggatgtcttcccgggtcaggacatccttgagcgtacttccatgaactcctgggatgaccagaaagtgcgtgacgcgctggcgaaaaacggcaagaaaaaagtggtggtagcaggtctgtggaccgaagtgtgcaacaacagcttctctctgtgcgccattctggaaggcgattacgaaatttatatggtatcggatgcctctggcggtacctccaaagaagcccacgacatggcgatgcagcgcatgatccaggtgggcgtgatcccggtaacctggcagcaagtgatgctggaatggcagcgtgactgggcgcgtaaagagacttacaccccggtgatggatattgtgcgtgagcactccggcgcttacggcatgggcgtggattacgcctacaccatggtgcacaaagcgccgtcacgtcaggaaagcgagcaccgcaccctggcgccggtaccggctccggttcgctaatcactgccgctggccgtcaccgggtgtggcggccagcgcctttttacaaggaggacctgtgagtcctttactaatttctctggcggcgggtctgcttatcgggctgatttacgcgctgctgaacgtccgatcccccgcgccgcccgcggtggcgctggtgggcttgctggggatgatcctcggcggtcaactggccgcgccctttatgcatcctgagcctgtcgcccgtacttccgatgcaaaacctgccgcttcttcccactcctcctccgtaacgtccagcgctaaacaggcgggttaaccatgctgaaaacctatattgtttctctgttaatgggtattctcgccggggtgatttataccctgatcgaagtgaattcgcccgccccgccagtgatcgcactgcttgggctgtttggcatgctggttggcgagcaggtcattccgttatgcaaaagattaatcagccgccagccggtgactctggcctggttccgtcatgagtgcgtccctaaaataagtggtacgccaccgccttcgggtgagaaacgcccttagaaaggcctctcaacctgttgtgagcctgtctaaggatatcagcatgaagctgtcgaagtgcattgtagtcgttgatgatgaacgttccgttcgcacggggctgagtaatttacttgagtctgatggctacagtacgcaggtatttgagtcggcagaagcgctgttaaatgatgacgccgccatccgggatgcggcgttgtttattattgatgttgaactgaaaggcatgtccggctttgaactcttcaaagcgctgggcgaacggctggaaaaaccgccgggcattattatctccggtaacggcgatgacaatatgatgtggtgcgcgatgaccctcggggcgattgcgtttttacccaagccgatcaacattgatacactttttgaacatattcatcagacgttttctcaccatgaggagggcgaatgagcagtatgcttctgctttaccaggcggccgaaatcgacagtttcctggtgtcagatgaaatgacccttactccgctcgccctggaagggaacgttgaatggctggtgtgtcgcgataacgcgacgggcgaggcctttacgctggcgatgcccgcctgcgaggaagcgggttatcagatcacccgccgcctgaaaaacgaatatgccctgcgcgacaccttgtctgaacgctgggcgctgaaaccgctcggctatacccagtttcagggacgttacgcgctgatgtatccggcgttcagctggcgcaccctttccgacaccctctgtctgcccaccggttcgctggttgatttccttcggcaggcgatcctgctgacgtccaccctcagccagatgcatcaaagtggtctggtgcacggcgacatcaaacccgccaatttcttcattatggatgaggagcgttatctgctcggcggttttggtctgactaccgacgcccaggcgcagcagtcccggctgccggtgacaggcggcaccctggcctatatgtcgccggagcatacctcacgcaccgccgatccggtgagcagcctgagtgacttatacagcctcggcatcgtactttatgaactgctgaccgggcgtttaccctacggcaatctcgacggcggccaggcggagtgggtgcatcatcacatcgcctccgaacccctgccgccgcaccggttgcgcaaggacgtgcccgtggtgctgtcggccatcattatgcgtttgttagccaagtctccggacacccgttatcagacggcggaaggactgctggcggatctctatcgctgccagtcgaatctgatgccggacgggctgctcagttcgttctcgctggggcagcaggatacgcgccgcagcgggttgacgtcggatgcgctctgctctgaacatccgcaggcggcggatattctttccgcttatgacgaagtgcacagcagcggcaaacacgcgctggtggtgatcgccgggccgccgggatcgggtaagtcctcgctgatggcttcagcactgaagatcctgcaacagaaacagacgctgctcaccgttgtgaaggcagatcagcactccccggttttaccctacgccattttcaccgccgcattcagaaccatcgcgctgcatctgcttggcctgcccgccatggagatgcagcgctggaaaacgcatattcagcgactgctgggcgattacgcggggctggcgattagcattattcctgagctcggcgtattgctcgggcaaaaggcggccttgcttaccgatgtgcactcgctggatgagcgggacaaattcaactgcatggcctgcaacctggtgaaagcctttgcgacgccgggcagaccgctggtcatgctgatcgacgacgtacactgggcggatcaggcgaccttccaggttttacagaatctgttaagccttagcgatgatattccgctgctactggtgctgtcgcaccgggacgaagcctcgatgccctgtccgattgccagcgccaatctggcgcgcattcgcgcggcggcctcgcgcattatcgacatcacgccggagccgctgtcggtcaaaaatattgcccgtctgctggcggggcagttccatgccagaaccgccgaaaccaccgagctggcggcgctcctgcatgagaaaaccggcggcaacccgcagttcacccatgaactgttccgtcaggcggtgaaggacgggctaatcagctggcagaaaccgatgaagtggacctgggatcgccatgcgattatggcatttcattattccgataatgtcgcctcgggcatcgtcgccaggctggaaaacttaccggtgcacgcccggcagttgctgggacggctcgcctgtatcggcggcgcgggcgacaccatgctggccgcgcacatccttgacctgtcggtagccgaactggtcgcccgtctgacgccagccgccacggcgcgattcatttccctgaccgataaaaaatacgcctttatgcacaccagcgtgctggaagcggctgccgggctgatcccggcggatgaaaaagacagcctgcacctcttcgcggccagcgcgctggcagaaatggcgggcaatgccatctccagtgagccgctgttcagggcggtgcatcacatcggggcgatcaagaattatgccctgctgcgccctgacgccgaccccttcgcggcgctgatcctgaaagcggtgaaacgcgccaaagtcaccggcgattacgcctcggcgctgcgttttctgcacaccgcccaccatctgaatgcgctggtcagcggcgacacccgcgccatgtttatgctggaggaagccgaatgcgaattcctcaacggtaacctctgtgcggcccgtgaactatgcgccacgctgctcggcgcgccgggcgatctggcggataaagccatcgccgcctgtctgatggcggagatccatatgcgtcagtcggacagccagctggcgctggaaacggcaatcgcctggctggcggtgttcggcatcaagttgaacctccatcctgacaaacaggagtgcgatacggcgcgtcaggccctgaaagcggatgtgggcaaaaacccctacagccgtttcagaaacctgacaaaagtgacctgccgcgaaaccgaagcggtaatgaatttaatggccagcgccagcacctatgcggcctttatcagcccgcgtttgcagttcatgatcctctgcaaactactgcatctgacgctggcccgcggtatcagcggcgcctcgaccttcgcgctctcctggtatggcgtgctgtgtggcgatcattacgatgagtacagccggggatttgccagcacgctgctggcccgccagctggtgtataagcacgattttgccagctataaagcgcgcacgctgctgccacttgaccaggtgagcatctggacgatgccggtgacttacgccattgagcaggcaaaagcgaccttcgacgtggcggtggaagttggcgatcgcaccaccgcctgcctcgcgttgcgccatgtggtgatgaactatctggcgcgcggcgatcacctggacggcgtgctgacctctatcgagcgcggcctgagctacgtgcgcaaggcgcaatatcgcgacgtcgaagtgatcctgctgatgcagcgtgattacgttcagttcctgcgtcagccttgcagcgaaggattttccggtcatcgcttcacgccgccggagctgcacgttgtgcagtcgggtagcgccgtggagcccatcttcctgatgcagttctggtccgggttgtataaaggcaaagcgcacttcttagccggtgaatatgattgcgcgagccgctgctttgcggagattgccgctctgactgggctgatccccgggcatacccatatgctcgatttccatctctacagcgctttaaccctgtcggtgcccctgtcgccgacagcggtgacggatgacgtgctggaaaaatttaaccgacatctggacaaaatcaccacctggtgcgccgagaatacgaaaaccttctccgataaagcggcgctgttgcaggcggagctgctgcggctgaaaggcgacgcgaccggcgcggccgaaaaatatgagtccgcgctggcgctggcgcgcgacggacagttccatcacattcaggcgctggcctgtgaactggccgcccgccttgccaccaccaccggcatgcgctttgccgcggaagcctacataaaaggcgcaatcagcgcgtgggaacgctggggcgcgggcgctaaagtacgtcagctggagagccgctatccacatctcaccacccagggcacgtagacagcgctggatacgctcgctttcgagcagaacgccgagataagcgacctccagagtatggtgaccgcgatccgcgccctgacggaggagatcaatcttaaccgcctgatcaacacgctgatgatgatgctggtggaacgggccggggcgcagcactgtctgctgatccgtctgatcgacggcaatattcccgagatccaggcgcgggcgaccactaccgccgaaggcatcaaagtcaacattgtgaaagaaacaccgctggccaccgatttgccgctctccgtactggcggcggtgatccgcaccgggcaggagatccgcaccggcaaaccggaaacgttcagcccgttcagtcaggaccattatctggtggcctcgggtgcggcggtgatgtgcgtaccgatgtttaaacaggcgcaaatggttggcgtgctgtatctggaaaaccgtctgctgccggatgtgttcaccgccgagcattcgcggatcgtctctatgctgggcgcgcaggcggcggtatcgctggaaacggcgcgactgtacgctgaactgctggatgaaaacatccagcgccgcaaagtggaaaaacagctgcgcgccagtcagaagtcgctgatgttaggggaaaaaatcagtcacaccggtacctggcactggcacctggaacaggacatcatgctgctgtcggaggagtacacgcgtatcgtcggcctgccggatcatcagggcagcttgtcgatggccgattttatgacccgcgtacacccggatgatttcagcgtcatcaacgatctggtgaccatgagcgtgcgcaatggtcagccgatgcaggcagagtttcgcatcatcaggccggacggcgtgtgccgctacatcaagggcatcggcgagccggtggaaaactggccggaagtgaaagagtatttcggcaccatcactgacattaccgcgcagcgtaactccgaagacgcggtgcgcattgcccaggccgatctggcgcgcgtggcgcgggccaccacggtagggcagctgacggcgtccatcgcgcatgagatcaaccagccgctgatgtccatcgtcgccaatgcgggcgcggccctgcgctggctgaaacgcgacccgcagcacctggaaaacgcctgtaaaagtattaatgaggtgatcagcgaaggaaaccgcgccggggatattattcgcggcttacaggcgctgacccgcaaccaggaagcggaatttgcccaggcccggctgcatggcctggcgcgtaatattcactccctgtcacggctggagatggagcggcgtttcatctcgctggagctggatttccgggcgaccaatgaccgcattttctgcgtcagcgtgcagatccagcaggtgttgctcaatctggtgatcaatgcgatggatgcgatggcggacaacatgggcgtgcgcagcctgcggctgtcgtcttcccagccggatcctgcgaccattcagtttgacgtcgcggataacggcagcggcctgacggaggcgcttatcgaaaagatttttgattcgttctttaccaccaaagccgaaggtatggggatggggctgaccatcagcgccgagatcatcaagcggcacggcggcaagctgaaagccgccagccgggagagcggcggcagcattttctctttcacgctgcctgtgcagccggaagagagcgtctgatcaccctcagctgtgtttattatcgaggttaagtttttcggtggctttgaccagatcggaaagggtgcgcaccttcatcttttccatcacgcggcgtttatggactttggcggtgatttcgctgatgcccatctgcgccgcaatttgtttgttgagtaatccggtcaccaccagctgcatcacttcgttttcgcgctgcgtcagggtgcgggcgcgcgccatcagttcacgtcgttcttctgcgacggccatctccgcttcagaaaaggccagcgcatccgccaccgccagcagcagcggatcgggcaacacgggcttggtcagaaactcgtaagcgcctgctttcatggcctgtacggtaaccggaatggtgccgtaaccggtcaggaaaatagccggaatggcgtagcccagctcgcgcagattgcgcgtcacctcaagcccgttcatatcaggcatattcaaatcgacaatcaggcagcagggggcagggtagtgcgaatgggacaaaaacgcctgcggtgaggtaaaggctgaaacggtataaccttccgcgctgagaagattgcttaacgatgagatgaccgcttgttcatcatcaaccacataaacggtgcgttccagagaagaagtcgtcataggctttgccggattttgctaacagaatgttaatatacctgtttagccgattgtttctatcaaaacctgccctgttaaccggtttagcacgctgaaagctgtaatttaatacaatgcaacacattgatattgctgctccctcagactgacaggctgtctatacttagaccgcgatatactgactggaggtaaaatggaatatctgtcccgattaaatattgtcaatatactgttatcgaccaccttctggatcaatgtggcgattgtcgttgtcgttaccctgatcacttattacttaatcaggcgattaatttcatttgcttataagacaatcgagaactggaataacaaacatactgatggcggtaatctgcggtatatcctttttgatatgctgagaaagaccaaccggttattaatcctgttcgcgtcgttcctgttcagcctgcgttttaccgcgctgccggatcgcttattttccaccatttcccacgcctggtttctggttcttgccttgcaggtagcgatctggctcgatcagggcgtgcagtcctggatgcatcgtttactccatgcgccgggatcaaaccgtaacccggtcaccatggttattctgggcatgatattacgggtgctggtctggtcgatgatgttgctgtcgatcctcgccaatgcgggcgtcgatatcaccgcgctggtggccagtcttggggtgggcggtattgccattgcgctggcggtacagacggtgctcagcgatgtttttgcgtcactgtccatcggcttcgacaagccctttgaaatcggcgatttcattgttttcaacgacgttgccggtaccattgagcatattggcttaaaaaccacccgtattcgtagcctcagcggcgagcagatcgtctgcgccaacgccatcctgttgcagcagaccatccacaactacaagcgaatgcagacccgccgcattgtgttcaactttggggtggccagttcaacgccgcccgaaaagctgcgtatcatcggcaaaatggtccaggacattattgaggatgtgggcgaaaccaagtttgaccgtgcgcattttctggcatttacccaggatcgcctgaattttgaagtggtgcatattgttaataccgccgactacaataagtatatggatattcagcaggagattaatatccgtattctggaaggcttaatcgcaaatgatattgaactggcgctgccgaacatggtggtcaggacgccggataatggcgcgcaatcgaccgttaatatgccagtgacggtaccgcagcaaagtaattaatcccaccaatattggtaggcccgcgtaaattagcgggtctgccagcgatgaaattcgtattttcttactaagataattctcataatcctgttatatgaacattcattaagttcgtacgtgattttttacggtaaattcatgtaaaaattttgtgcagaaataatgcaacatatttcacaaccaaggatgttcattttatgaccacgttaaagcctgccttattactttcggtgtgtattttaaccgcctgtggcggcggtggtggtggcggtggtggtggtggcgataaaacgccgccgaccacgacgccgccggtgcagacagacaatggttctggcagtaacgctggcaataacaataccggcaccacgccgcaaccgcctgccagcgcgccgacaagcctggccaccgggggcaccctgtcaggctatacctacaccacgccgcagggcctttcctataccatgcgcggtaccggtatcgaaccggcctatgtctttacccagtcgctgaccagtacggacggcacccgtcattccgccacctcctggtgctgcggccgtatgagttacaccacctttggcacctggaccgactttaaaacgggtaagcatgacgtgttctacacgggcgagccgacgctggccgccaacgtgcccacgcagggtacagcgacctatgtcggtaacggcatgcgtgaagacattcgcagcgatgccacttttaacgtcgactttgccgcgaaaaccatcaacggcaacattgccgcaggcgacgccttcggcagcgctgtggcgatgcagggcaccattgcggacggcggtttcaccggtaaggcgcagtcaggcggtcaggacggtaccttcaccggccacttcaacggccctgccgcgcaggagctgggcggtcttgccagcttcgccgacaccagcaaaaacgtcgcttttggcgcaacgcgtcagtaactcgcctcccggccagcccgtctggccggtttttcatgatggtataaatccctatgaatgtcctgcgtacaggcgcaataagcctgttgtttccgctcggcgccgccttagccgcgccgccggatactgacgtcattcccgctgcaccccattttgatcgtctgacacagcaggataaaagcacctccgccgccggaacctttatctctgttaacaatgcgcaacttgctgaacagcctgagctggcgacggcgctgctcgatcaggccgtgcgcgaaggcaaatggccgatggtggaagccattctgccggtgtatgaagcgtcagccagcgccgatcccacgctgatccgcttcgcaaaggcggggctggcccgcagcaagggcgattacgatcaggctatcgcgcactaccgcgccattctgagtgaacatcctgaacttgatgcggtgcggctcgacatggcccgcgccatgtttgaaaaccaccagtacgatacggcggaataccagtttcgccgcgtgctgcaaagcaatccgccggaaaatatccaggcgatcattggcgtttatattgaacgtattcaacagggcagcgatctgaccggcagactcagcgtcagctatcttaacgacagcaatgtgaataacgcctcgacaagtaaaaccattcgcatcggcgatcggctctttttacgcaataaagaaagtttcccgcagcggggagagggcttctggtttaacggcgcactacaaaaggatgtctctttgtataaccagcatggcctgcgctttatgggcacagtgaacggcaaaagctactggaataatcatgatttcgatgatattaccagccgcctttatgctggttatcagtggcgggattaccgccagcagttcgccctgctgcctttttatgaaaaaagatggtacggcacggaagcctattcttccggccccggcgtgcgggcggaatacagctacctgctttctcccgcatggcagataagtcaggcgctggaatatcaaaaactccattacgatgccgacgaatacggctttttgcgcggctatagccgttattcttcaaccacgctgtctcatgctttcagtaatctggtgtcagcctatgcgggcgtcgatattcaggatcagcaaaccgcggcaaaaagtgaaactaatcagcggacaggcgtgcgcggcggggtacaggtggacttaccctggcagatttcgttttcggcctccacggccttcgcaaaacgtcattaccaggccgacagtgaaatattctccacccgccgcaaagacaatgagcagtattataatttgtcgctctggcaccgggatctctatgtatttggcgtgatgccgaagctgaatttcagctataaacgcgtcgacagtaatatcaatttttacgattaccatcagcgcaatatcacattgtcgctggataaaaacttttagcggcgtaatggcgaaaaaaaactggcgataactcgccagtttttttattgctgaaatagcaggaagggcattaccgcatggtgacaaattcttcggcggcggtcgggtggatcgccacggtattgtcgaaatctttcttggtcgcgcccattttcagcgccacggcgaagccctgtaaaatctcgtccatgccgaagccaatgccgtgaatgccgacgattttctcgtcttcgcccacgcacaccagcttcatgcggcacggctgacggtgggacgttaccgcggtatacatcgccgtaaaggacgatttatacactttcaccgcctcgtcgccgtactgctcgcgcgcctgcggttcggtgaggcccacggtgccgatcggcggatggctgaacaccacggtcgggatattgttgtaatccagatgctcatccggcttgttgttaaacaggcgctcggacaggcgacgacccgccgcgaccgccaccggcgtcagttcaacggcaccggtgttgtcgcccacggcataaatccccggcacactggtattctggaacttatccacgacgatgtagcctttttcgtcggttttcacgcccgttaccgcgaggttgaaattgtcgttggccggtacgcggccaatcgcccagatcaggcaatcgacggttacactgcggccatcttccagcgtcagcagcaggctgccatcggcatttttcaccaccgacttcggcaccgcgtgggtgtgaagcgtcgggccgtcggccgccatcgcttccaccagcgtttcgctcagcatgggatcaaaactgcgcagcggcgcgtgtttacgcacgaacaggtgcgtctgcgcgccaaggccgttgatgacgccagccagttcaaccgcgatgtaccctgcgcccaccaccgccacgcgctgcggcatggccggtaattcgaagaaaccatcggagtcgataccgtattccgcacccggaatatccggatggctcggacgcccgccggtggcgatcagaatatggtcagcggtgatggtttcgccgttcacctcaacggtgtgggcgtccacaaaacgcgcgaagccgcggatcacatcgacgtgatttttacccaacacgttgtcataggagttatggatgcgatcgatataagcggtacggctggcgaccagtttattccagtcgaagtgattgatggtggtatcaaagccatagtccggaccataaagctcgattgcctcgcggatctgcgccgcatgccacatcacttttttcggcacgcaaccgacgttaacgcaggtgccgcccagcgctttggcttcaatcagcgcacatttctggccgtacatggccgctctgttgatcgaggcgatgccgccgctgccgccgccaatggcgagataatcataatgcttagtcatgaccgttccttaatagagtcgcatttgagcgcagtgtaacgcgcggcttaaaaggttccaccgatggttgcgattactccggcaccacccagttcaccagcgtatgccccgtaccggctggcaccagtttgctgtgcagccatggcagcacgttttgcatctgttgctccagcttccacggcgggttaatcacaatcatgccggaggcggtcatgccgcgctgatcgctgtccgggcgcaccgccagctcgatttgcagaatgcggcgaatgccggtggcttccagctctttcaacatacgtttgatttgcgcgcgcatcaccaccggataccacagggcgtaagtgccggtcgcaaaacgtttgtagccttcgctgatgccctgcaccaccgcctgataatcggtttttatttcgtacggcggatcgatgaggatcaggccacggcgggacggcggcggcagtttcgatttcagctgttgatagccgtcgccacgcgccacggtggcacgggcatctttctgaaattccgaacgcagcagcgggtagtcgctcgggtgcagctcggttaattgcagcgtgtcctgctcgcgcagcagctggcgggcaatcagcggggagccggggtaataacgcagcgtgccgctacggttaaaatggttcagcacggtgatgtagggcgtcagctcttccggcagatcgtcctgctgccagatacgggcgataccttcgaggtattccccggtgcgctcagcgtgttcgctggcgagctgataacgacccgcaccggcgtgagtgtccagatagagaaaaggcttctctttttctttcagcgattcaatgatcaggctttgaacggtatgtttaaggacgtcggcatgattgccggcgtgaaagctgtgacgataactgagcatgtagcgcgttccaatgacctgaaaagaagtatgccgacagtataccgaaaagtggccgccaccgcgaaagcgcaacgtccggcattgaaattaactacactaaaccccataccagaccttatcggaaaaagcgctgatcgggcgcttaacttatttattaaccaggacagcgcttatgaccaatccattactgacgcctttcgaattgccgccgttttccgccatcaaacctgagcacgtcgtacccgctgtcaccaaagcgctggacgattgccgcgaggcggtagagcgcgtggtggcgcagggcgcgccttacacctgggataatctctgccagccgctggcggaagtggatgaccgtctgggccgtctgttttcacccgtcagccacctgaactctgttaaaaacagtccggaactgcgcgaagcctacgagcagacgctgccgctgctgtctgaatacagcacctgggtcggccagcacgaagggctgtaccaggcgtaccgcaatctgcgcgatggcgacgcctataacgaactggatgtggcgaagaaaaaagccgtcgataacgcgctgcgcgattttgaactctccggcattggcctgccgaaagagaaacagcaacgttacggcgaaatcgccgcccgcctgtccgaactcggcaatcagtacagcaacaacgtgctggatgcgaccatgggctggtcgaaactcgtcaccgatgaatctgaactgtccggcatgccggaaagcgcgctggccgccgccaaagcgcaggccgaagccaaagagcaggaaggctggctgttaaccctggatattccaagctatctgccggtaatgacctactgcgacaatcaggcgctgcgtgaagagatgtaccgcgcctacagcacccgcgcctccgatcaggggccaaatgccggtaaatgggacaacagcccggtgatggcggagatccttgccctgcgtcacgaactggcgcaactgctgggcttcgacagctacgcgcacaaatccctggccaccaaaatggcgcaaagcccgacccaggtgctggatttcttaaccgatctggcgcgccgcgcccgtccgcagggtgaacgtgaactcgcccagctgcgtaccttcgccaaagaagagtgcggtgtggatgaccttcagccgtgggatattgcctactacagcgaaaaacagaaacagcatctgtacagcatcagcgacgaacagctgcgcccgtacttcccggaagaaaaagcggttaacggcctgtttgaagtggtgaaacgcatttatggcatcaccgccagagagcgtaaggacatcgacgtttatcacccggacgtgcgtttcttcgagctttacgatgagagcaacgaactgcgcggcagcttctacctcgatctgtatgcccgtgaaaacaaacgcggcggggcgtggatggacgattgcgtgggtcagatgcgtaaagcggacggctcgctgcaaaaaccggtcgcctatctcacctgtaactttaaccgcccggtgaacggcaaaccggcgctgtttacccacgatgaagtgaccaccctgttccacgaattcggtcacggtctgcaccatatgctgacgcgtatcgaagcggcgggcgtgtcgggcatcagcggtgtgccatgggatgcggtcgagctgccaagccagtttatggaaaactggtgctgggagccggaagcgctggcgtttatctccggtcactacgaaacgggcgagccgctgccggaagcgctgctggaaaaaatgctcgccgccaagaactatcaggccgcgctctttatcctgcgccagctggagttcggcctgttcgacttccgtctgcatgcagaattcagcccggagcagggggcgaaagtcctcgaaaccctggcggaaatcaaaaagcaggtcgcggtcatcccgggtccgacatggggccgtttcccgcatgccttcagccatatctttgccggtggctatgcggcaggttactacagctacctgtgggccgacgtgctggcggcggacgcctattcccgcttcgaagaagaggggatcttcaaccgcgaaaccgggcagtcgttcctggataacatcctgacgcgcggcggttccgaagagccaatggagctgttcaaacgcttccgtggccgtgagccgcagctggacgccatgctggcgcattacggcatcgaaggctgacagtagcgtgaaaatttgtttgtcagatgaatcaggcaccggagacggtgccttatctgttcttgcggcccgctgggcgctggagcatgacgcggataacctgatggcgctggtgctcactccgacgcatcttgagctgcgtaaacgcgatgagccaaagctcggcggcatctttgtcgattttgtcgaaggggcgatggcacaccggcgcaaattcggcggcggacgcggcgaagcggtggcgaaagcagtcggcgttaagggcagttatctaccggacgtggtggatgcgaccgcaggcttaggccgcgatgcctttgtgctggcgtccattggctgtcgggtgcgcatgctggaacgcaatccggtggtggcggcgctgctcgatgatggtctggcgcgtggctatgcggatgcggaaatcggcccctggctgcgggagcgtttacagctgatccacgcttccagcctgaccgggcttgatgaggtaacgccacgcccgcaggtggtctatctcgatccgatgtttcctcataagcagaaaagcgcgctggtgaaaaaagagatgcgggtgtttcagtcgctggtggggccggatctggatgcggacgggctgctggaacctgcgcggcggctggcgaccaaacgcgtggtggtgaagcgcccggactatgcgccgccgctggcgggcatcgccacgcctaacgcggtggtcaccaagggccaccggtttgatatttacgccggaacgccggagtaattcctctctcccgcagggagagaggctatctgaaccttactcgtcttcttcgtcgcgcagcggcacgatcagcatatcaacgtgaacggtattgatcagctggcgcgcggaggacatcagtttgctccagaaatcctggtgatggccgcagaccaccaggtccatatcgtatttcttaatcgcatcgaccagcacctgacctaaatcgccgctgccgctcagggtttcggtgatcggatagcccgcgttggtggacagctcggtcagcgcgtgatgcgtctcttcggagatgcgcttctgcatatcgccaagattcacatcgataaggccggtataaagatcggagtagttaacatcaacatggatcagcgaaaccttcgcattgtaagggcgcgccatggataccgctttctcgaccagaactttgctttccggggagagatcgactgcgatcaggatatgtgtgtaagccataatgttactccttccataagttgtcgatgaccagtgggttagcagctcatcctgcgttgtgctgtgtcccgcgtcctgcatactatttgcgcggggaatgcccggccttaagagtataattgtagaagatatttctaccttataacgcacgatctctgccgtcaatccgcctggctcacgctttactgcaacaaataatcgatttgcaggtcatgattacgattaaccttgtggtaaaaaaattaacggatctcctacactatttaatgagccgtccggataaataaatgtgatcccgctcggtttctggtaacactcttcactgaactgttttcgctgagtatcggggagcgagagtcccgggggatttctccgtgggcggatcgccggggagggggtatggtcagcaccgtcgcgctgttttgggctttgtgtgtcgtttgtgtggtgaatatggcgcgttacttctcatcattacgcgcattgttagtggtacttcgtggttgcgatccgttgctctatcaatatgtggatggcggaggattttttacctcgcacggacagcccagtaagcagatgcgcctggtgtggtatatctaccagcaacgttatctggaccatcatgatgatgagtttattcgtcgctgccagcgggttcgtcagcattttattttaaccagcgcgctgtgtggcctggtggtggttagcctgatcgccctcatgatctggcactgagcataaaaaaagcgggccagtaaactgacccgctttgtatgcttcctgcccgcgcttaaatcagtttcagcgcgatccagtacagtccgccggacaaaataatcgacgccggtaaggtgaagacccaggccatcagaatgttagtcacggtttttctttgcaggccgccgccgtccacaatcatcgtccccgccacggaagaggagagcacgtgcgtggtggaaaccggcatcccggtatagcttgccagaccaatggagaccgctgcggtcatctgtgccgacatcccctgtgcgtaggtcatgccttttttaccaatcttctcaccgatggtggtcgccacacgacgccagcccaccatggtgcccagacccagcgccagcgcaacggccatgatgatccagaccggcgcgtattcgatggtgctcagcatatcgcctttcagcttcttcagcagacgctggtcttcagcgctgacatccggctgcttggccactttgtcggtaatatcagagatacacagcaaaatgcgacgcagctggccgcgctgttctaccggcagtttgtcgtagctttcgatattggtcagcattgctttagcgcggtccagcgcgttaatggcgcggcccggatggcaatggaactcgttcggtttggacgccacttcttccggcgtcgggatcagcggatccacaccggtggctttttgcagcagcgcaggatgctgctggaagtaggtttcgacgttattcaccgcatcacgggtacgggtgatgtcataaccggaggcgttcatgttcaccacaaagcctgctggcgccacgccgatcagtaccagcatgatcaggccgatacctttctgaccatcgttagcgccgtgagaaaagctcacgccgatagcggacaggatcagggcaatacgcgtccagaacggcggctttttcttgccgtctttcttttcacgctctgccggagtcatatgaatgcggtcgcgttttttgctgccgttccagaaacgacgcagcaaaaataccagcccgcctgcgaacaccaggccaacgattggcgagataatcagggagccgaagatattgataactttaggaatgttaagcgcgtccaccacagaagagccggtcatcagcgcattggttaaaccaataccgataatcgcgccaatcagggtgtgagagctggaggccggcagacccaggtaccaggtgccgaggttccagataatcgccgccgttaacattgagaacaccatggcgaggccatgcgccgagctgacgttgagcagaagatccgttggcagcatatgcacaatcgcataggccacgctcagtccacccagcagaacgccgaaaaagttgaacaccgcagccataatgaccgcgagttgagaacgcatcgcacgggtatagataaccgttgccaccgcgttcgccgtgtcatggaagccattgatggcttcgtaaaacaggacaaagaccagagcaagaagaagtaataacccggtatgtaaatccaggccggcaaataaatgtagcatatacgttacgccattttgaggtcatgaacgcggcgcattatcgtggacaaccgcggtgcggggaaagtgaaatatagactttttttgataattttccttaggttgtaaaagcgtaaaaacaattatcttttatttttcaaatagctgtcatcgaattgacatatttttgctggtgcgaccagcggcgaaaatttacaattcgccgctcattaatcaagaggatcgtcgtgtggaaaggtttgatgccatcgtaattggcgccggagcggccggaatgttttgcgccgcgcaggccggacaggcaggtaaacgcgtcctgttactcgataacggtaaaaaaccgggccgtaagatcctgatgtctggcgggggccgctgtaactttactaacctttatgtcgagcctgcggcttatctgagccagaacccgcatttttgtaaatctgccctcgcacgttatacccagtgggattttatcgatctggtcggcagacacggtatcgcgtggcatgaaaagaccctcggacagctgttctgcgacgactccgcccagcagatcgttgatatgctggtggcggaatgtacagcgggaaaagtagtgatgcggctgcgcactgaagtgcttgaagtggcccgcgatgacgacggttatacgctgacgctgaacggcgataccgtcagcgccgacaaactggtgatcgccagcggcggcctttccatgccgggcctgggcgctacgcccttcggctataaaattgccgaacagtttggcctgaaggtgctgccgacacgggcaggcctggtgcctttcacgttgcataaaccattactggagcagttacaaacgctttccggcgtgtcggtgcccgcggtgatcgaggcggaagacggcacggtattccgtgaaaacctgctcttcacccatcgcggtctgtccggcccggcgatcctgcaaatttccagctactggcagccgggtgaattcgtcaccattaatttgctgccggaatgcgatcctgaaagcgtcctcaatgagcagcgggcgggacatccgaaccagagcctgaaaaacacgctggcgatgcacctgccgaagcgccttgtggagtgcttacagtcgctgggacagatcccggatgtgaccctgaaacagcttaacccacgcgaccagcaggcgcttattgaaacgctgacccggtggcgggtgcagccaaacggtaccgaaggctaccgcacggcggaagtgacccttggcggcgtggatacccatgagctgtcgtcacgcaccatggaagcgcgtaatgtgcctggactgtattttattggcgaggtgatggatgtcaccggctggctgggcggctataacttccagtgggcctgggccagcgcctgggcgtgtgcgcaggcactcagcgataaataaattttgatagactcaaaatatttttagcaaatagcccgataagaatcgggctattttatttctccgcttttccgcagccattaattatataagcgttcactgctaactaatttataaaattaaagttattgagcgttatgccgttatccattctatacctcccctacctgagtcatatttatcatgctatggaaaaccacccagggtcgttttagcctgcttcttgttggatttttctttattttagtgctggttacgtttttcgtgattaagcattttgtctcgccgcaaattgtcgccacggaaacggaactggttcgtcataccgttgccctgcaaagtaacgctattaaagaacaaatgaaccgcgtgaaagcgcagcaaaaaacgatcactgaacttgtcggcaccctcgacagtgcgcagatcgatcaactgctgccaaatttggtaaaccagtatggcgatcagaatgtgttcggcggcggtatctggccattaccccgtctgcgcgatcctgagcgcgagaagttcagcaccttctttgcccgcgacgctggtggagtactgcaggtcaataccgtgtggaaccagccggaagcagataaatactgggagcaggcctggtataaagacggcctgaacgccgccaaaggcgaatgtgcctgggcgcgtgcttatcaggatgctgccagcccacagccgcggaccaactgcgccatggcgatatggcgtgatggtaaaccctggggcgtggcgaccattgacgtgacgctcggctttttcaatcagctggccgcagacatgagtaaagcggttgagggtaacgttctgattattgagcaggacggaaaaatcgtcggtaatggcgcttccacagaaggcggcaaggcgctgaataatttacgtgaccttaatctgccatcttctcaggcattattgtcgctgctgaataccggccaacaaaagtcttatgaaggaaagtattctggatcggacggtgagcacgcgttatttgtgctgcccattgaaggcagcccctggttcctggccgtcgatctgccagccagtaagctggagcaggcatcgaattctattctgaccaaattaactattgttcagttaacgctggggatcgtcttaatcctcgtcttaatgatttttgtgcgcaatattttcagaaacgtcagcctgttaaataacaatatccaggcactgtccagaggtggcgctgacctgacccaacgcttaaccgagagtaaaagcccggaatttaacgctatcattcagaacttcaatgcctttattacctatttgcaggaattaatgcagcaggtcgggcaaagcgcgcaggcgatctcttcggcatcgcgccagatcgctggcggcaaccgcgatctgtcagcccgtaccgaagatcagtcatcgtcgattgtggaaaccgcagcctcgatggaagagctgaccagcacggtacgccagaacgccgataacgcgcaggcagcaaataagctctccagccaggtatcgggcgccgcgcgggaaggggcctcggtggtgaacgaggtggtcagcacgatgagcagaattaatgactcatccgtgaagattgtcgacatcatcagcgtcattgacggtatttcgttccagaccaatatcctggcgctcaacgcggcggttgaagcggcgcgtgccggtgaaaacggacgcggcttcgcggtggtcgcgggggaagtgcgctccctggcacagcgcagcgccacctcggcgcaggagatcaaaaagctgatcgaagagtccgttgcgaatatcgagcagggcggaagtctggtcaggcaggccggcgtcaccatgaacggcctggtggaaaaagtggaaagcgtaaccaccttaatctctgagatcagctcggcgagcaacgagcaaagtaagggtatcgatcagattaatatggcgattaaccagctcgacagcaccacccagcaaaacgcggcgctggtgcaggaagtagctgcggcagcgcaatccatggaagaacagaccgttcagctggaaaaaatcgttaccagctttaaaatctaagccccgtatgtccagcggtgcctgaccgggcaccgctggctcctcgcattaaaaccttatcttcccaacaatcccaacacactactgttgctattcattgattccgtcttgcatgttaagcgtaaattttacaccttcatgtaattttctgtggccgatgtcattatgtataaagcggatgaatagttattgactttttataaaagcataaatgtcaattatataaaatatttgtttgcgggctaaataagcatgcttttaattcattgcttttataaattcattgtcgttcatttattatataaatgcatttcgcgtcaaattcctaaaaatagcttttttagtacgtgatggtttagccatgtcacagggagtggtattttattacgtaattcctttcgtaaagtattacatcgtcaggaagtgagcctttagcttacgatattccttcgccagtatataaggagtctgttgtgtcaaataattcgtttcaatcggaaatacctaaagcgcgcgtcaatattaaacttgatgtccacaccggcggtgcgcaaaaaaaagttgaactgccgctcaagctggtcgtgatgggggattacagtaacggtaaagaagaacgcccactttctgaacgtgaaaaagtaaacatcaacaaaattaatttcaacagtgttcttgccgatttctctccttctcttagcctgactgtagaaaatacccttgcaggtaacggaactgaagaaagcgttcatctctcctttaaagaaatgaaggattttgaaccagaacaagtggcacggcagatcccccaacttcgcgccatgttggctatgcgtaaccttttgcgcgatttgaaatctaatctgcttgataacgttaccttccgtaaagaactcgaaagcattctgaaagatcccacgttaagtaatgagctacgtgaagaactgaatgccctggcgccaaatgaggcgtaattccaacctttaacggaacaatgcgagataatgcttatgtcagtcaataccgaaaatgcttcagttgctcagactaccgtacttgagcgtcctgaaggtggcggggtatatgcttccctgtttgaaaagatcaatcttacacctgtttctgaactgaacgacctgaacaactatcaggatggttcagctcttgccgatgtaactgcagatcaacgtgtaacggccgctgttcaggtatttttggagcgtctgaaacagtctggtcagactgttgaaagactggataaggctttgctggatcatcacattgccgagctcgatttccagataagtcgccaacttgatgttgtcatgcatcatgaaggtttccagcaggtggaagcagcatggcgtggcctaaagtcacttgttgatcgtaccgattttcgtcaaaacgtaaaaattgaagtgttagatatttccaaagatgatcttcgccaggattttgaggattcaccggaaattgtccagacgggtctctattatcatacttatattcaggaatatgatacgccaggtggagagcctataggtgcgatcatttcaaactatgagtttgatgcctctgcacaagatgtcgcgctattacgcaatatttctaaaatctctgctgcagcccacatgccctttatcggttcagttggcccggcgttcttcctgaaaaaatcgatggaggatgtagctgctataaaagatattggaaattattttgatcgtgcagaatatattaaatggaaagcattccgtgaatcagatgatgcccgctatataggtctgacaatgcctcgagtgctcggccgcttgccttatggaccggatactgtaccggtacgtagctttaattatgttgaagaagtgaaaggccccgatcacgaaaaatatctgtggacaaatgcttcattcgcctttgctgcaaatatggtgaaaagtttcattaaaaatggctggtgtgttcaaatccgtggccctcaggcggggggagcagtaacagatctccctattcatttgtatgatcttggcaccggcaatcaggtaaaaatcccttctgaagtcatgattccggaaacccgcgaatttgaatttgctaacctgggctttatcccgctgtcctattataaaaaccgcgactattcttgcttcttctctgcaaactcggctcagaaacctgcattgtacgatactgctgatgcgactgctaatagccgcataaatgcccgtctaccgtatattttcctgctttcccgaattgcacattatttgaaaatgattcagcgagaaaatataggtaccaccaaagatcgtcgcttacttgaattggaattgaatacctgggtgcgtggtctggttaccgaaatgaccgatccgggtgatgacctgcaggcatctcatccactacgtgatgcgaaggttgttgttgaagatattgaagataatcccggtttcttccgcgtgaaattatacgccatacctcatttccaggtggaaggtatggacgttaacctgtcgctggtttcgcagatgcctaaggcgaaagcgtaagcgggggaaggatgaaaatttatcgtccgctatggactgacggggcctttctggccccacaacagtttcaacagcaggctcgctgggatgcttacgtgactgatgctgtcgcccatatggcactggcgcatccatggggtgtggttgaggcagattttgatcgcggatcgctggctttatctcgcctgaatgcattgcgtctgaaagtgcgttttcctgatggcactgtaattgatactgaactcgcggataacttaccccccgtctgtgatttatcttccgtggctgatcgtgacaacatagaggtggtgctggcattaccgttgctttcagcaaatggcggaaaccttgacgatggacaggacagcgcgcgtcctcgccgctggcggcaggaatgggtgacggtacaggaactttccggtcatgagcgcactgaacttgctgttttacggcatgccgttacgttgcgctttgcacatcaggataacagtgcctatctcatttgtcctgttgtgcgccttatccgtaacgttcagggacagtgggaactggatgataatttcataccgccaatgctttctctgtcagcaagcaaaaccgtatttaccgagctgggggatttactccatcggctccaggctcgacgtcgtcgtctgatggagatgcggcgtgaaagtaatgaaaggatggccgattttgccgtcgctgacgtgtcgctattctggttactgaatgcattaaatagcgccgaaccagtgctaaatgagctttatcaatcaccctctcgtcatcctgaacttttctaccgtgaactcgtacggcttgcaggtagtttgttaactttttcacttgagtataaggcggaggttatcccggcctatcagcacaatagtccggagcaggttttcccaccgttgtttaacttgttggactctctacttgaagccagcctaccttctcgtgtgattgcaatagaactgagccttaatggccagttctggacaggctctttacatgatgcccggctccgtgagggggctgatttctacctttcggtccgctcaaatatcgctaaccaccttttgcaaactcaatttccattgttgtgtaaggctggtagctacgaagacgtctcagatgtggttaacgttgcacttagcggggtagtcatgaagcctctaacccacgtgcctgctgcaattccattacgcctggaaaaccaatatttcgcacttgatcttaatagcgccgctggtcaggccatgctggattcaggtaactgcgccttttacacgccaggttctctgggagaagtaaaacttgaactgtttgtggtgctgcgctcatgaacaaaataaatacatctgttgttgatgcgattttttacccctgctggctgatggtcagccaactacgcagcggagaggaaattaaagatggtgaagcgctttatcggcgtgcttgtgagtgggttgataaggcacgtgaagcactaactcaggctggttttagcgacgccagttgtaatcatatgctttatacgcagtgtgcactacttgatgaaagcgtgatgaatcgtccgcaccaggatagtggttctgcaaaatggcttaaagatccgttgcaagctcgctatttcaacacgcttaacgccggagaagaactatgggagcggatccgtactgtattacaggagccagcacctgacattgctgtgctgacctgtttttatcgcgcgctcacattaggttttgtaggtcgttaccggcagcaaggagacgaacgtcgggaggatgtggtacgtaggctgagtcaccaagtaccaccatttaccatggctcaggaaacgccaattgtatccagatccatgagtttacgctccgggcgcaaagtttactggttctcgtggggggccgggatcatgattttggtggcactgtggttgatgcttcgcagtgaacttacgcagatggtctcgaacctggctgggatgcaatgacatatgcgtagattaactcaatcattgctgctgcttactggtagtgctctggcgctatggttgatccttggcttctggccgcttgccaccagtagccgcactgcgctcagtatggcagttattatcttctgtaccataagcgggtatgtactctggcgcagagataaccatcatcacattgcctatgctcatatcagccatatcgatttaccacctgaagattttgttggtgctgtagtgttagtttgtggagatactacatctctgttttctccatccgtatcttttcgggaagcccggcagggctggtatctggcggtgcagttgccagaacacttgcctgctcttgcccaacatcttgcaactgaacgaccagcacttattgcgcgaatttctgtgctgctcgcacttgtgccagagcaccatcagcgactggatgatctcactcagtcgctacgtgcctggcaccgggccattgtgcagtgtaaagcatggttttccggtattcctcctgtctggatcaattgctggctttcgccgtctgaaccttcctcgcaagaggcagaacgttggtttacggtgacaccagttcaaatgggtattcatgtacgcgaagcgggggctggtgtaatgcctctgcgtgaatggagtcacctgagggatagtgaaaagagtcataaaagacttagcaccatactgacggtagaaagccttctaagttggtttcatattcacgtcacgaatgttacaggacataaacaaggtgaactcccgccgctaatcccctgtgtttgggggtgctgcttaacacctgttcaaggagtagagaataacctgtggcaggcacacatcacagccataaccacccttcggcctgcaataaccggggctgtggattacctcccgttgccagatgttttgctaccgtatctttctcgtcgaaatggcgtgtcccgcctgatgcaagtctggcaacagattggtctactttttggaacatttttgttattcgcgatgctggcttcgtttcttaataaccagcgcctggtccagagcattggggatcacttgtcacttttttaccgccttcctccgttacctcctacacctaaagttcatgcacagcagcaactgcgtgcagatgctcatttgctggatgaatggttaagagcgggagcgccgatgcgtctgtcgctgggtctataccagggaatgcgattgatagcccctttacaagctgcaatcaacagctgggcagcaccgcctccagtagtccagaaaatcgtacaggggcccaggacgataagtctggacagcctgtcgttgtttgacgtcgggaaatggcaactcaaagctggctccaccagagtattgatcaacgcattggtggggataaaaggccgtccaggttggttaattgttgtggcggggcataccgatgataccggagatgaaactgctaatcagcttttgtcgcttaagagagcacagtcggtacgtgactggatgcgggatacgggtgagatccctgaaagctgttttgccgtccagggctatggcgaaacacggcccctgaaaactaacgacacggaagaaggccgggcagccaaccgccgcgtcgaaatcagtctggttccacaggtaaacgcctgccggataccagggaaaaaagcagtgtcaccggatgtaagtgacaccttaatgcaataaatggagaaataaataatggcaattccaatttatctttggcttaaagacgacggcggcgcggatatcaaagggtctgttgacgttaaagatcgtgaaggcagcattgaagtcgtggcacaggatcacagcctgtacattcctacggacaacaacactggcaaactgacgggtacacgcattcatacccccttcctgtttaccaaagaaatcgattcctcctctccgtatctctataaagcggtaacaaccgggcagactcttaaatccgccgaatttaaatggtatcgcatcaacgacgcgggtcaggaagttgaatatttcaacaccaaactggaaaacgtcaagctggtgaaagtcgcaccgaaaatgcatgacatcaaagatcctgcgatggaaaaacataaccatctggaaatgattgaactgcgttacgaaaaaatcacctggacctataaagacggcaacattattcattccgactcctggaatgaacgtaccaccgcataacacctgcagcagacggcgagccgtctgctgtttttgttttctgagcggcctggtagcgaggcagttcagaaaacaaatacaagtttttatttcgacctgatgcgctttggttcatagcgacgggcggtagcataggcactcaaggagaagtgaacatggaacatcagtcagcagtcttgcttcgtcgtattaatccgtactgcgctaaagcgctggaagccgcagccacattgtgccagacacgggcgcatgctgaaattacgatagaacactggctgttaaagctgtttgagatgggcgagggcgatataacggttctggctcgtcgctacgagtgggacatggacggtatatggcaaagtttgctggggcatctggatgcttcgccacgctcggtgcaaactcgtccgcaattgtccgccaatctcgaagcattgatcaaggccgcctggcttgccgcctcgttgcaggatgatagcccgcatataagaagtgtacacctgctggaagcgcttctttctcagccgggattattgagctgtgaagggttatggccactttttagccttagcaaaactcaaataaggcgtctgaaacctttactcgatgcccagtcagatgaacgtccggaactgcaacagcaggagattctggaccagatgccttcaactcttgcgcgtgacgttccaaaaaatacggggatctcctccgataatttaagcgaagcattacaggctgcgctggataaattcaccctggacgtaaccgccaaagcaagagctgggcagattgatccggtatttggtcgtgataatgaaatccgccagatggtggatatactttctcgccgtcgaaaaaataacccaatactggttggcgaaccgggagtgggaaaaaccgcgctggtggaaggccttgcgctgcgtattgctgatggcgatgtcccggatagcctgaaaaccgtcagtttacgtaccttagatcttggtcttttacaggctggtgctggtgtaaaaggagagtttgagcaacgtctgaaaaatgtcattgatgcggttcaaaactccccatggccggtactgctatttatcgacgaagcccacactatcatcggtgcaggtaatcaggccgggggggctgatgcagcaaatttgcttaaaccagccctggcgcgtggtgaattgcgcaccattgcggctaccacgtggagcgaatataaacagtactttgaacgcgacgcagcacttgagcgccgttttcagatagtcaaagtggatgaaccggatgatgaaattgcgtgtttgatgttacgcggtttgaaatcgcgttatgcgcaacatcatggtgttcatatcactgatgaagcggtaaaggcagcggttagcctgtcccggcgctacatcaccgggcgacagcttccagataaagctgtcgatctgcttgataccgcatcggcacgcgtacgcatgagcctggatacccttccggacacgttaatccggcttgcggcacaaatcagcgccctggaaacagaaaagcaagcattgctggaagatattgcattgggcagtagtggctctaatgaacggctgggacaaattgaaaagtctacgaatgaactcatcgcgcaacgtaacgtactaaacattcaatatctgcaagaaaaaacactcactcaacaattgcttgcaacacgacaggacatcagtcgtcaggctgaaattagcagtttgcaacagcagcttactgaattacagaatggtgctcctctactttcgctggatgtagacgtacgtaccgtcgcaaccgtaattgctgactggacaggtgtgcccttaagcagcttgttaaaagatgagcagaccgacttactcatgcttgagagccatttaagcaagcgcgttgttgggcaggatcaagcactggtaaatatggcgcagcgtctgcgggcagcgaaaacaggtctgacgcctgaaaatggcccgttgggggtgtttctgcttgtggggccgagtggggtgggtaaaacagaaaccgcccttgccttagctgacagcctgtttggtggtgagaaagcgctgattactattaacctgtcggagtatcaggaagcgcacacggttagccagttaaaaggctcgcctccgggctacgtcggatatgggcagggcggcatattaactgaggccgtacgtaaacgcccttacagcgtcgtgttacttgatgaggttgaaaaagcacaccgtgacgtaataaaccttttttatcaggtttttgaccgtgggtttatgcgcgatggcgaagggcgtgaaattgattttcgcaatacggtgatcctgatgactgccaatctcggcagtgatgcattgatgcaaatgctggatgaacagccggatgcgagagatagtcaactgcacgagctgttgcgcccaaccctgcgcgatcacttccagcctgcgttgctggcgcgctttcaaacgttgatctatcgtccccttactgctgttgcgctgcgtactatcgtgaaaatgaagctagaccaggttgcgagccgtctgcgtcggcattatgggctgtcctgcattattgaagaaagcctttacgatacgctggtcgccgcctgcctgttgccggataccggtgcgcgtaatattgacagtttgctaaaccagcaaatcctgcccgtgctgagccagcaattactgcaacgtaaggctgagcaggtacgtaccgaaaatctgacactggggtggaatgaagaagcggggattgtgctggaatttgatcatggagtaactgaatagagcgtgccgatgatacagtaaaaatgcatggtggttatttattatcctgaataattaatttctataaatatgttgtagccatctcttgaagcagtgtggagaattttcatggatagcgcaaaagaaattgcacaagatatgcttgaagcaatcaacgtggatgggggaggttttttaggcgcagtcgctaagggttttatctcgtttcctgtcagcttatattatcttggctatgatttcatgcatactgaggatcgcagagaaaattatgaagataagattagagttgccaggcttgtaaaatctgacaacatcaataaagaaatactagagagaatcatcagtgactttatggatgagttttcatcacgcgtagatatagaaaaagttgttagtatgattaaaaatactactggcacaattattggcaaagcgttatttgcacaactctttggggttaatctggggaagatattaacaaaccatgctattacggctttttttaagaacagatgctggagctatacttacagtcggtgctgaagcatcctgagcgatttatgtatcacgatacttacgtgacagaaacccttccttttactataaattaaaatatatgggaaacttggatctattatattatttggttgaggatattgtgagaccatttgaagcagtctgcgacattcatgacaaaaatcaagcagactttgataatctttgcaagtatttctttggtggtttatgaacttaaaaaaggttgtagtttttgttttttcatatttcgcctgtgctgtcgcaggagcattggttacatttggtttgatttttactgtttggttcttttttttctcaaaaagtgaagattctttattttggtgtggagcttcgatgttgctaatttttctggggtatataatcaatcgaattgcatttcctcatatctagagcgttttctaaatactcatttattcccgtagttaggttaaatgttaatagccttaaatcctgcatgtgctcagtaagaaattattgtcaaaaggctttgccgtttaagaaagaaagtctgatacctggattgtccagaggtaaggttatgagtgactcattagatgaagatcttggtgaagatgccatatgggatctttacaaaaaaatcttaagaggcttttcgtggtgatattgaaactttttttgtaaaatttttggtattgcttttaacaatattagtactgacgggatgtccggggggaggagatagtattcttcctcgttaagaagcaaaattaaatattattgataataagttttatttttgggtcgaaggcacagtcgaatatcagatagcccatatttccatcaaccccagaggaacatcttttcgtcgccagaaggtgtaatttaatccgcaaattaaaacgttgaacgggaaattatgtatcccttcatcattcttcctttttcctgaacatggacagtttttagttgaatatgtattgtcatcatatagctcttcaacaattatagttacaggagttaatttttaaaatgtggatgtcaggcttattcaacttacgaaggatgaagtcgtaagatagttgatcaaattttatttaagatctccgtaccttttttatcaatgaaattttcactgtgtttttaaaatatattatttgaattttttatttcattatgtaaataagatgttaagttagggattgcactggaggtgtatgatgaataggaaaaacaagaatgaatttaatgaggggggagtccgactattgagtattggtgagataaaattggctaaatctgtttttaagtccactatagactacagcaccgtgtggatccataaggaaagctatttaccgtttaatcttcaggataaaaaaactgcgatggcgcctaatggtgaaatctattttcgtgatttttatagagatgatttctctctgtccacggatgatattcagcacctgtttattcatgaaatgagtcacgtatggcaacgtgcgaagggaatgcatgttattacaagaggcttgattagctggctggtttcttatcgatatatgcttgacggtcggttgttgagtgagtatcccatggagcaacaggcacaaattattgcggataattttactttgcaaacccatggatatgcagtgtggtatcgtttgtggagtaataaataccccgcggtgacgcttgatggagaaactgctgaagcagtcgttcggcaaaaatactgggaggcgttacgaggattcccatggtgaaactatcaaaattccgctctggttttttagtaggggggattttcctcagccttagtacacttacgggttgtcctggagtaggtgacaggatggaatttgatgaaagcgcagaggtcagtgttaaaggcaaggatgtctgctttgaagtcatagatccgcaagattatcagccggtagatatggctatcaatccgcgagggacgctttcaataaataaaagaattatttttaatcctgccctgactgttattaaaggggagttatgtatacccccttctttttatgatttccccgataaaggacaattcattgttgagtatactttaacgtcaaaacaaaagagagaaaaatcaagaaaagtggtggttgtcttgggtgttgcggatggcaaaatctataatatgatacctgccgataatgaaatctccagaccttatgatgaattaagtcaataaaaaggcatgagtattagacggcgattcgaataaattttctatccttaaataattaaaatcccggtaagtatatggagtaaaaaccatgagtatcattgatcagaattcaactttgcttaatgaaacgctgaaccgctttcgacttgttattccttcatgtacttccaaacttgatgtggaggaattcagcggccgagaggtattaagtcaggtgtattattacactattgttttcaccacaccagataaagatattgatgcgtcccaggtattgagaaaacctgccagtcttactatgggcattggtctgttacacagcctaacggaagataaagtagtacatggtattgtgagcgactttcgtcggatatcaggctctaacgacgaggcgcaatatattattactctggagcccttcctggcattgctgggtaagcaaatacgtactcatcgcttctttgtcaataaatccgtacctgacgtagtggcacagatcctggatgagcatggtttcaaaggttgggaatacgaattcaatctcaaacaaaattatcccaaacgtgagcagatcaaccagtatcaggaaagcgacctggcgtttattgagaggttactttctgaggtaggcatattttatttttttactttgcaaccagatactcataccgaagttgttcactttgcggataaacagagtgcctatgaatttgataaaacactccctctgaacagcccgtcgggaatgagtgataacgcaaaggagtcggtgtgggggctgaacattcagcataatgtggttcaggcgggggtgatagcgaaggattataatcatcgcgaagcgcagaaagtgttgcagtccgccagagcggatatgacgcgccgcgacggggcagatataacctacggagaggtttatcactacaaaccacgccatcttgaaaccggcgataaaaatgatccatctgctgaaacagctaatttcctggctcgtcttgatcatgaacgctttctggcagatcagacccttattaccggcttcagtacagatgtaaccttgcgacctgcacaggtattgacggtaaaggacgataccgttccctccacattacctgagttactgagcttaccgatggtcgtgatacgcactggatttatggccagtcgaaaagatgcgctcaaggtaacgcttgccgcagtgccttacagcgaaaccctgtgctggcgtccaccgttaaaaccccgtcctacaataagcggtacgatgatggcaagagtcaccagcgccagggcagacgacatttatgcctggcaggatgcagccggactgtaccgggtaaaatttgacgccgatcaggacgacaaagctcagggccaggagagcatgcccgtccgccttgcgaaaccctacggcggtgacgtatacggatttcacttcccgctaatccagggcacagaagtagctattgcattccacgatggtgacccggatcggccatacatcgcccatgccctgcacgactcccggcacgtcgatcatgtgacagaaaagaataatacacgcaatgtgatgcgtacccctgccaacaataagttccgcatggaagacaagcgtggcgaggagcatatcaagctcagtaccgagtatggcggtaaaacacagcttaatctcgggcataacgttgatgccgcgcgtggtttgcgtggtgaaggagcggaactgcggacggatgactggatttctattcgtagtggcaaaggcatttttctgagcgctgatgcgcaacctaaagcgcaggggcagatgttagatatgggggcggctttagcgcagttacaagatgctttgcaacttgttaccgctctggcgcaaagtgcaaaggtatcgggtgcgctggaggctgatacgtcttctcaaagggagcttaatcgtgctctttctcagctacagagtgcagggttgttggcatcagcaccggcgggaattggtttaacaacgccaaaaaatatccagctctctgccggacattccctgaccgctacagccggggaaaatatcgatatgactattttcaggaagcttacggtagccgcaggtgaagccatcagtctgtttgcacataaaatgggaatgaaaatatttgcggccagggggaaagtcgatattcaggcgcaaactgatgctatgagattgcagtcagataaaacgatgaatatgaatagtgttaatggtgaaattatccttaatgcggctgaaggaataacgcttacaagtaagggcggtgcttacatcaaaataaaagacggatctgtagaaatcggcgcgccggggagaatagagttgaaaagcatgaatattctctggggaggaattgcttcacttgaacaagctctctctcctgttgcggtaagcgacccgcagtttcataacccaatgaatggtagttttcagattgttgatgaagttagtaaacagccaaagccatatataccatacagaattgaaaccgaggatgggcagattatccgtggtgcaacggatgcaaatggctacacgcaggcacattatggcattgatcctaaggcaataacgttgttctttgaataaccagggagtgaaaaatgagtgagcaagggaaagctgcagccgaacacaaactaagtaaatccgaaagtaatgtgaaggtcgttacccataagtcttgccagtgttatttcagaaccgaaacgctacaactaatattcattgatgaagctgaagttgccggttttgaaaaggcaatggataaactttgcctattgatagatgagcatcataaaacaaaagctaattattctgaggcgattgaaaattacggtatccgaaaaaaggatattgcaaaccaaaatgatttatcagaatacaaggctaagatcgccaacacagaggctttgcttaagtctgccactgaaaagctacagcaagagttaggcgattttaatgagcaaacgggatattcagcagtggtcgagctaattcctctgcaaccgcttaaaaaaagtaagtatggacgtcgttattcatatattaaagagtgcgattttaaaaaattcgaagataagttaataattattcctgtcgatgtttctgctgatgatggtatattcaagaaagatgatgatggaaatattatcggaatcgatatcgattcgttaaagacaaaactggcagcagcaaaaaataccattaaacaaatgatggatagcaccatgacgatgagtgctgatgtggattatgaggcaacgctgacagaatgggctgacgcatggaacagtgagtcaggcgcatacaataaagaaggccactatattgatgtttcagccggggcgcagtttctgcggtttacggcgaatgcatccacgcttaatacctggaacccggatacaggagcggtacagattaagggagaagcgcattctggtctgacgctctgttctggcacactcaatacaacgctttatgtcccggatcgtacaggctggcccctgaagtttatggtcaatgatactaaagaagccaatatagggattttacgggccagaattgacggagagctgacgggatatgttggagcttctgcgcaggccgaaggcaaccttcagtttgtaacatacaataaaaaacagttgctgatggggaaccgtacgccaggagtcccttttagtgaacgccagaatggggtaaagatcaaagatagcaaggagaatccaaaaagcctggaaataaaagcagaagcatttggtggcgcaaaggctggagccagtcttggcggcgctctgcagtggttaaagccttttagttcactggtcgatgagcttcccagtatgctgcatacctttggcatggattcaccagcactggaacaaatcctgccatctgtaaagcagtcacaagagaaacaaaacgaccaaacgggagagtttcaggattttgcttgtttgaaggtaggcggggatgtggaactgggcgtgggattaagtggtgagtttaagatccgcttcgtaaaaggccgctttagatttcatattaaaggaagcatatgtcttggcccgggagcaaaaggtgaagtagagggagaggtttcacccgaattgtttggagagtttgctatttgggtgatataccaattatatggtatcgattatagacacttaactataattgcagatgatgcatttaaagcacttacctatatacttgttatgggcggcgctgaaatatactctaagtactataataaaatgcgagcagaattagaaggtgtgaagaaggattttgttgattttattgatgacatgacgaaaggtttgatgaaggctcgaagtgattcaactaagcgtaatgattttgcatctttaataaacaaggatcctggctgcgtctttttattttctccagaagcaaaaggtattgcactttatgtgcttactaaagatggcgcatatgatcgtattgatattaacaaccagggcgatggttttctacctgatacaaataaaaaacgcaaaaccgctgtattatatgttttgtccagtattcagaccaaacgcgaatggaaaaaagtgttgtctcgtattagcaaggatggtacagcgctccccggtaatgaagatgcagtagtcaaacaggccgaagaaagtataagaaattttttacaaataggttttaacaaagacaaggagttagaggatattattgataagttagaactgagagaattcaatcaggtcttcaaacggcttaaagaaaatccagcttatggttatgcgttctcacctaattgcactaaacagtactttttacactgtgatgataatccgttttatagttctttatgtcattttggccctgttaactctgaatataaacaaaaatgggaggcaaatgattgatgcgtatttattttatagttctgttattatttgttagcggttgtgataatgcaacggaaactaaaaaacttaccgctgacgaacaggctgaacttaaacagtttgtcaataaaatcaaatcagagcttgtctacgtcaaaggcggaacgttctggatgggagatttctgcaaaaaaatgcgcaatggtggaccttattgttcatcagaaaaggataataaaccattgcatgaagtggagcttgagagttattccattagtaagtttaaagtaactcatgaagactatgacttctatttaaaaatgaaaaagttgccaaaaaagaattttgaaaagaaaagctacaatgaaattttttataatatgatatattttgaaagaagtccggcgattattacatggactgaggcttttaattattgtgattggttaaaaaaagaaactaaaatgcctttttcgcttcctacggaagctcaatgggaatatgcggctcgtgcgcgcggtcagtatattttagtggcaacagatgatggttcttggcggaaaaatgaaaaaacaggatatggtgaaaacttcgctacagatgaggataggtgggcagtagagaaggatttaggcatcgatagtacttctatacatttcccggtagataaatatcctcccactccacttggaatgtatggtatggctgataatggttgggagtgggtgcatgactggtatgacccttattattatgaaaaatccccaaaaaaagatcctcaaggtccagataaacctatagtcaaagatgatgattctggacaatatctgaaagttttacgtgctgtaaatcatcttgtacccggcgcgccagaaggcgttacttttagtcgagcatcgaatattaaagataatccttatccagccagtacaacagtacgttgcgtcgttaattcaccggacccaataaaatgaaccaaaaatccataaattatagcctgtttcttttcttactaatcggtggttgcgacaatgccagtcaggcagtaaaccgtactccacaagagcaggaagaattacagcaatacctcaagcgtataaaaaaagaccttgtgtatgttaaaggcggaacgttctggatgggagatttctgtaaaaaaatgcgtaatggcggcccttgttgttcatcagaaaaagatacaaaacctttgcacgaagtggagcttagtagttattccattagcaagtttaaagtgactcatgaagattataatttctacttaaaggcgatgggtttgccagatcagtatgtaaatgaaaattatcaaaaggagatgctggcaacgatgactcactttgataatagtcctgctgtagtgacatggacagaagcaaataattactgttcttggcttggaaaagttacagggcttcctttttcaatgcctacagaggcgcaatgggaatatgcctcacgcagtcgcgggaaatatataataattgcgacggatgatggcacatggcggaataatcccagtactggattagggggaaattatgctacagatggggatcgccgcatagtggaagaaacttacggaataaatggatcactagtccatttccctgtagataaatttcctgcttcacctttaggattgtatggcatgtcagataatgggtatgaatgggtaactgactggtatgatgatgagtattataaaagatcaataagaaaagatccgagaggtcctaataaccctgtaatgaaggatgaggacactggccaatattttaaggtgttgcgaggcggtgaggcccctggcccaggtagcgaagtggggttcacgttttatcgtgcctacagagttaaagataatccttatccagccagtacaacagtacgttgcgtggttaattctccgcacccgataaaatgaaccaaaaattcataaattgtagcctgtttcttttcttattaatcggtggttgcgacaatgccagtcaggtagtaaaccgtactccacaagagcaggaagaattacagcaatatctcacgcgtgtaaaaaaagaccttgtgtatgtcaaaggcggaacattctggatgggagatttctgtaaaaaagagcgcaatggtgggccttattgttcatcagaaaaagacacaaaaccgctacacgaagttgaattaactggttattcaataagcaagttcaaagtgacgcatgaagattataaatgctatctgaaaattgctgggttgtcagagcaaatttttgcacataaatttgagagcgaaatgttgtctgatatgacttatttcaaaagaagtccggccatagtaacatggacagaagctaatgagtattgtaactggttgagaaaagaatccggacaacctttttcgcttcctacagaagcgcaatgggagtacgcggcacgtagtcgaggtcaatatatcttggtctcgacggataatggcgtctggcgtagtaatgctaaagacggtagaggcgaaaattatgccaccgatgtagatcgtcaccttgtggaggattctcttggaataaatagtatattaattaatttctctgtcgataaataccctccaaactcgataggattatttggaatggcagagaatggatatgagtgggtgctggactggtacgatcctgattattatagccggtctccggtaataaaccctcagggtcccgcaaaaccggttattaaagatgatgatagtgggcaatacctcaaagttttacgtgggggaaataatcctgatccatcaggggatgtcgggttgacgttttttcgaggctacaaaataaaagataatccttatccagccagcacaacagtacgttgcgtcgttaattctccggatccaataaaataaatttccttgatgtgttgtaacgcttttattctaactttttctacttttactaaattttaatttaaattgaaggtgccagtgttggggtgggtaatatagttatttatattttcagtgcaagaacaggtgcagcctattaaagtgctcgtgtaataataatctttgaggttttctcacagtaaatgattatatggaggtatttatatgcttggcgtaatacggatcggagataaaacctctcatggtggtaccgttcttgagggcagtgctggtctcatatttatgggtaaggcagtttcctgtatgctggataaagtatcctgccctgtacatggcgtaacttttatcgcagaaggcgatgttggatctaaatggaatgggcgtcctatcgctttgcatggtcatcggtgcggatgtggttgtacactgattacctccctgccaacggcggggaaacgttaagctatgcctgtagaaataaggaatttgccagaacctaaagtgttgcctaagcctcctgaaaaaatgcgctggctcgtttttatagctatctgcatgcttactgggtttatattaacactttatttttggccgaaaggtaaaccagcaaacactttttggttctggatatgtgctactttgattccatcggccctggggttaatatgctatgcaataagattacgtcagtatgaacatctggtcgagcaagtttcacactggaaccagttatatgcagaggaattaaaaagcagagaggaagccgggcaacaggcattagggatgctgggaatggcatatgtcacccccgcagcgaaaaataaactggctgctgcattattgttgggtgcaagccctttgcaaactgtttattgctctcgtactgcctcggtggtgagtaatgcactccttcacccaccagctaaaagcaatacggttgcggaatattgctctcgtttagaaatgcacctttacactttgctgcgtatgctgacgcctgagttggaacagtatgcccttaatgagcctgtaacggtgcgtatccgtcacgatcaaacagtaagtgatacctgctttctgagtatatggcaacgcattttcccggagcgatacgctcttcatcctattattttcagacccgacgacgatgggcttatgtggctggatgagtggctggacgagcagagtccgtcacttgtactttctgttgaggtcaatctctttggagataaaggtgataatcaggctgagtcaatttcattgttattactggcttcgccagcgtggataaaggaaaagcatactagtccactggcgtttattcatcgtcctgtatctgtgataaaggcagtagaggatatagatgatgttgtacgctggggtaagctttcacctgatgaaggttattttatctggcgaagtcaactaacgccctccagccagactgaaataattgaggctatggatgctaaaggttatttatttaataaagatcgagagcattcgttagacaattctttcgggaaacctgattttgctgttgggcatattacgcttatttgcgcctgtgaacatgcaagttcttcacaagtaccgcagtggatcatgttagaagataaaatgcctcagtgcgtcattgtacgtccagcgtaattctgcattaaggaaagttaagtgtacaaaaaaagacgatttagcacatggatagttgttattgtattgcttttaattggcagtgcgcttatctggttcgataatcctgttattcacttaccaactcaacaaaaaaaactaattgcttctcttactttgtttgggatttgtttcggatggttgctatgtgatgatttatttttaaggataataaaatctgttgtttcgtcagagtatttccgcgcattaaatatccgcttgattaagcagagtaattcaaagattaaaagccaggctagcgaaaattcttatgtagttcaaatgaaaaaacttcgcgtggctttgcacatgaactatggtcgcttttggcctcgtagagtacgtatcatcctgctcactggcagtatcaatgacgtagagctgcttgccccaggccttgcagaccagctctggcaggaagacagaggtacgctactgctgtgggggggagatccctctgcacctttagacgcggaatggtctgaagccctgagcaaacttcgccgccgccccatagatggtgtggtctgggtgacctctgcgttcgcacaaaagcaccccccctccaacgatatgattgagcgaatgtcacaggcattaacttcccgctgtggcttgtcaggctggcggttccccctgtatgtctggtccctgcacggcactgaaagtaaagatcatgttcgggctactcaggccgtaggctgcctgctttccgtaaactgccagccagaagtgttgcgtaatcagcttgcagcgctggtacctcccttaattgaacaaggaacgcagcagatcagtaactgttccaggcatcaatttttactgcagcttgccggacaactagctgatgacccgaattctgtcgctgaacccctgggcgatttactcatcccctggcaacctcttccgcttgccgggatcatgttcagtccggcttctgcaaataccacgagaacggttcggcaccactgggtaagggataatcgctgggatatcttgctggagtcgttgccttctctgcccactggtcttgtggcgaaaaaacgcggtgttgcttggggccaggtcatgatgttcatcctcacgggcgctatggtgctgtggggggcaggaatggcgacatcgttcctggtaaatcgcggaaccattatctcagcaacatcacaggtcagacgcgccgccgacgaacaacagccgctccctgtgcgtctgcaggcccagctggatttacagcacacgctggatcaactgacataccggcaacagcatggcgctccctggtatagtcgcgctggcctgagccagaacgatgcgttactgatggcgctctggccgcattatggagccaacgcactgcccctggtgcgtgatgccgctgcccggcatcttgaggctcagttaaatactctgttaactttatcgccagataatccacaacgcgaaagtctcatgaaaccagcttatgaccagttaaagctctggcttatgctggcctgcccggaaaaaatggacgcagcctggtttagcaagacgttgctgaaaaactggcaacagcgtcagggcataccggacaatctctggcaaggcagcggaccggccctgctggatttttatgcccgccatcttccctcacatccgtcatggcgtcttgagccaaatacgcagcaggtgagccaagtccgtactctgctggtacgccagatgggcgcgcgtaatagcgacgcttccctctatcaaaaaatgctcgtccaggtggcgaaccagtacgctgatatgcgtttgtcggacatgaccggcgatacggatgcggcacgtctttttacaacggacgaggttgtaccgggcatgtttacccgcaaagcatgggaagaaaccgtccggccagccattgagcggatagtcagtgagcgtcgcgaagaaatggactgggtgttaagcgacaacagaacgaacgccttacagcaggcgtccccggatgcattgcaagcgagccttgaggcgcgttatttcgccgatttctctgcaagctggctggcctttctcaacagcctgcggctccgtccggcccggacgctatcggattccatagatcagctcacactgatggctgacgtgcgccagtctccgctggttgcgctgatgaataccctgagcgtacagggtaaaactggccaacttactggggcattgccggattcgctggttaaatccgcaaaagatttattaaaccgtgacgagaaacctgcttttgatcagcaaacgggcgtacagggcccgctggatagcacttttggccctgtactgtcactgatggcgagtggggacagcatgactctgagtctgaaaactttcctgacccgcgtcactcaggtgcggcttaaactccagcaggtagttaatgcccctgatccccaggcgatgagccgaacactggcgcaaaccgtgtttcagggaaaggcagtcgacctgaccgaaacccgtgattatggcagccttgtcgccgcgagccttggtcaggagtggaatggattcggacaaaccgtatttgttcagccggtcgaacaggcctggcagcaggtactgacgcctgccgctgaaagcctcaatgcccagtggcaggcagcaatcgtcactgactggaacagtacgtttggcgggcgatacccgttaaaaaacaccagtagtgaagtgtcacttccgctccttgcccgctatctcaataacgatagcggtcgtatcgctcactttttgcagacccggctcagtggtgtgctgcataaagagggcagtcactgggtaccggacagtatcagtgcacaagggctaacatttaatccagcttttcttgatgccgtggatatgctgagcgctctgtctgatgtcgcctttgccggaggggaggcgggtattcgatttgagttacgtccgggaacagctaaagacgtgatgcagactgacctggtcatcgacagccagaaactcagctattacaaccagtcgccgttctggaagcggtttaactggccacatgataccgagttccctggcgcaagtctgagctggataagtacgcaagcgggaacacgacagtacgctgatttgccaggcgcatgggggttgattcgcctgctggagaaggctgaagttactccctatccaggcgtaaacagtagcttcagtgttacctggaaagctcctgatggcaggccgttgcattacaccctgcggaccgaggcgggggaagggccgcttgcgctgctgaaattacgtgatttcagattgcccgagcagatttttagcgtaaacagacccggaacagaggacgtaaattaatggcaaccttgacgacgttattaaacgccagtcatgccgatccgcttgtgatttcacaacaggccctacagcaggctttactgtgggaaaactggctggcacctgtttccctggattctccagcgggaagcgatccaggttatgacgatgatttccagcagatgcgcgaagaagtcaataagctatccggcgcagacaccgctttaatctgcgatctggcagagaagttgctcacctcaacctgtaaagacgtacgcgtcgcaacttattacatctgggcgcgactacatacggatggtgaaagcgggcttgctgatgggctgtccttgctggccgcgttggttcagcgttttggaacagccttacatccgcagcgtggtaatagtcgcaaactggcgctggagtggctggcgagtaaccgtatgctggacagcttatctttatatcctgaggtggcaaaagcggactttgagcgcattgtgggtgcgctgcttttaaccgaggaaataacagcgctctggaacgaatcagagcgcccgcagtttggtgggctttatactgcgctggaaaaccgccttgcgcaatccggtggtccggatgcggtgatcccgcaaaacagtagcgccacgattattcactctacttctacgtcggcggaaacgccggtgttgaaaccggttacctccggacgtgacttactcgatcaggcgaaattactggcaaattttttgcgcgatcagccctacggctggttatccgcccatcatctgataaaaagcatacgtctggataccttacacgaacttcctcccctggcagcagacacgcgcacacggctggccccaccgaaaccggaacatcgcgcgatgctaaagcgcctttatttgcaacaaagctggctggaattacttgagcagaccgagagcttttttggtcaggcggtcaatcacttgtggctggatttgcagtggtatatccatcaggcactcagcaaagcaggcacgccttatgaaaaatgggctgacattattacgcatgatttacgcggtttactccatcgcctgcctgggcttgaaggactggcttttagcgacggcacgccctttgccgatgaagtgaccctgaactggatcaatcagcacgttctggtggctgaaggctggcacgatgaatctgcagcttcagccagtacggcgggccacgatgaaatcttacaactggagccagaagccctggcacaggcggacagcgaaggcgttgaagcggcgttgctctggctgcaacatcgacccgcgatgcacacgcctcgtcatcagtggctggtacgtctgctgatggcacgggtcgctgagcaatacggcaagaacgacatggcactgcatttgctcaatgaactggactgcaaggctgccaaattaatgctctcgcaatgggagccagaattgttgtttgaggtgaaagctcgtcgtctgaagctacttcgcatcaaaattagtcgatccgacacggacaaatcacgtttacacagtgaaatggaaaccctgcttgccggattgattgccattgatcccgcaagagcggcagtactgtgtgggtaattgataatgcctggtaatgaaaaatacatgaaagacttaaccctgcgttattacgacgctgaaatacgctatcttcgcgaggcagccaaagagtttgcacaagcacatcctgatcgggctgctatgttggatttggataaatcaggcaccccggatccctacgttgaacgtctgtttgaggggtttgctttttcaatgggccgcctgcgtgaaaaaattgatgatgacctgccggaattcaccgaaggcctggtgagtatgttgtggcctcattatttacgcactattccatcactatcgattgtggcgctgtctcccgccattcagtcaatgaaaatagcggaaaccgtacccgccagtatggaagtttattcgcgccccataggccccaaaaatactgtctgccagtaccgaaccactcgcgcgacggtgctcaatccactggaagtgtcaaaagttgtgatggcggctgagccggacgggcgttccgtgttgcgtttgcggctgacctgcagttcgcaaaccgactggacacaggtggatttaaggcggctttctttttatctggcaagcgacgctcctgttagcagcgcgttgcatctggcattaacccggcgacaggcagcactttatctgcgttttccggatcaagtcgacagggtacaaattgatggctggttttctccaggcggcttctctgaggatgacctgttatggccgaaaggtgaaagcgcttttagtggatatcagcttcttctggaatatttcaccttccgcgaaaagtttatgtttgtacatctcaatgggctggagaacgtgacattccccgttggcatcgctttttttcagattgaagtggtactgcaaagccaatggcagagcgacctgcccgttacggatgaggcgcttcagttgcactgtgtgccggttatcaatctttttccgctggaagcagatccgttgataattaacggactggaaagtgaatatcttttgcggccacgacgtttacaggacggtcatactgaaatttattcggtagatagcgtaaccgggtcacagcgtacctcgggtgctatttacgtgccttttaccagtttccgtcaccggggtgggatgcaacgacgtcatgcaccagaacgttattaccatacgcgagtcaagcgcggggtaacaggtttacatgatacctggcttattcttggcggtgtgcaatgggaggctgaccggcatctcatgcgtgaggcggtatcattgaaaattactggtactaacggccagctcccgcgaaaagcactgcaaagcacgatactcgatcgctgcgagtcagtgctacagacccctctcaaagtgcgtaacctttgtaaacctacgttacctgcttatcctccagctgaggatcgttttcaatggcgggtattgagccatctgggttcaagctatcttaatttgatgagcagcgcggatgtcctgcgtaacacgcttgagttatataactggcagaacgacgaactgaataatcgtcgtctcgatgccatacagcatgtcgcgcaccatcagatccagcgttttgaaaaaggcttcttactacggggtattgatattgaaattaccctcgacagtaatggttttactggcgaaggggatgttcatttattcggtgagatgctcaaccggttctttgcgttgtacgccgatatccacttgtttaaccagcttaccctcattgtgcaacctgccgggaaatgtatccgatggaaagagaaccacaaccagcgtttacccggttaatagagcaactgcgtgacaaactgccttacactcagttttaccgcttttgccagttactggaacaaagtcaaccggatcttccagcgctcggcagcggttggcagatcaagcacgatccagttcgttttcgtccccatccgggaatgggcttcccggccagcgaattcaaaggaatggaaatagcggagcaggctgacgaaccaccgatcatccgcactacctttttgggactgtatggggtggaatctcccttgccgacgtcttatatcgacgatattgcgcagcgcagggaaggctatgaggccgtgagtgattttctggatatattcaatcaccggatgatcactcagtattatcgtatctggaggaagtattcctatcctgcaacctttgcatccggcggccaggacagaacgtcgaaatacttgttgagcttgtgtggcctgggtattgaaggctgcaccaaaagcatagcaacaccagtctcgcgctttttagcgctgaccagcatgatgcgtctacccacccgtactactgaaggcgtggtggcgctggttcagttactggctccggatactgaagccatcgtgcagcctcatgaccgctgtcgtattcccttgcataagccattaacgatgagtgcgcgtaaccctgtcagtatgagcaacagtccgataatgggaacgcacaccatagatgtaaatagccagatcttattgcaactgaggactcataatgctgacgaagctgttggctggcttcctggcgggcaattgcatgcggatttgcacgctttgttgcaggtctatcttggagcacgccttcatgtacgcttacagctttgtgtatgtcgccgtctgttgccggatgcgcagttaacctgtcagcccaaaaagagtagcgtgctgttggggcggacagcggtgatgcgaccacagcaggtgagcataacagaacggcataacgaaaaagttattactattaatctgggtcgctatcagcgtattcaggaggcttttaaccgtagggagacggacgaacatggcgattaccgctggtaaaaagcgttttacattcataacactaattatggtggccacattatgcggctgtggattaacgcaaaaagtgggcgacagcaccgttgctatgaccagggcattatttttcaaacaagtgaaaatactgcatctggatattattgcacgggaggcagctaataataatgcggcaggaattccgctttcaacagtaattcgtatttatcagttaaaagatcgcaaggtgtttgatgatacagattatccatcgttatttgccgaggatagccaggctattaagtctgacctggttgctcaaaaagatattcgtcttcgtcctggtgcctctataacaatagatatgcctctggaagcttcagctaattatgttgcggtagccgctctttttctgacacctgatactgcaaataatacctggcgcgtggtgttaaaccgcgatgagctggatccggatgtggcgcggaagattgaaatgaataatcagacactagctcttctgccgctcaaggatgattagcatggcacaaccctccctttatgaaatgctcaccggcaactttaccggcggctttgatattcatcaggttagcgaagaaaatcaggtcatcatatctgtactggataatatgcagcgtattctcaatacccgtcagggctcgctcagccatctaccggattatggtctgccggatatgagtaaaattctgcaggggatgcctcgcacggcacattctttactggatacgctttcggcaaccctattgaaatatgagcctcgtctgaagcgcatacaggtggtcttgctgccgcagcatatgccgggccaactggaatacgcgatagatgccgagttacacgatttcggcattgtgcgttatgacacggcttttatgccggaaggccgtgtgcttatccgccatctcaggcaacaaaattaccttcagccgggcgacagctattaacgactatcagagacgttatcttcatgactattaatgactataccctgaaaacgggcggtgatccccgcgcgctggctgactttgccgctttgcgggaagaaatcagtaaacttacccatcccgctcgccccgacataagctggtcgagggttgaacaactaagcctttcactgtttagacagaatggcatcgaactccagacggtcgcctggtacacccttgcgcgcacccatctcaccggaatggcaggtctgaatgaagggctggctattttagaagctttacttactcatcaatggggagcaatgtggccgcaaccagtacatgcccggatggaaattattgccgggcttagcgtgcgtttgcaatctgtcctgcgcacgctgagcctgagctataccgatttacccttgatctaccaggcggaacagcatctcactgctttgcgcaatgtgctgcaacgtcttgaactcaaaaatgccagccaaatgggtgagttgtgtatgtttatgcataacgcggccacaagactggaaaatattgaaccccaccaggcgcaggaaatgccagttgtaattcccccatttcccgcagcgcaggcaaaactggccaatctttccccggtcacaccgctgatttatgtggcacatcaggatcaaaaaagtccgcctgctgtgatcacgcctccgcaatccccaaaactccaatggaaaggttttacgacaggtgtactgcttactctgtttctgggcagcgcagcgtgctggggctggcagtttgttgatcagcaggagagtattttaccgttgacggtttcggaggaggcgttaacaacacttgccgggcagtcatccctgtggctacaagactacggttttgcgctgagcaccaaagcgaaaccggaaaatatcgacaagtttaagatgcagtggcaacagcaaatcgtcagcaatgcattgccagttgaaaagctgtctggctggcatcagggaatggaaggactggaggatctgacccggcgtcttaatgagcttgatgaacgcaaaggtaaatatcttaccggatcggaattgaaatctatggtgtttaccattacccagaattttgcacgaacggagcctgttgaagaacaactctaccagcttagtaagatgacttccgggacaccggaactggccacttcactatcgcgtactgatatgcaccttaagcagttgcttaaccgctatatgctcatcaaacagcatgctgaaaagcaataataatcgttacttcagtgtccacgccgttcatccttgatgaacggcgcatctctttctcacatcaaacaatatcatccaccacgccgccgtccacgcgcagtgcagcacctgatgtcgctgacgcctgggtcgaacagacatagaccaccatattggcgacctcctcgaccgtggcggcgcgctggatcactgaactcgggcggttcgccatcacgaactctgtcgccagtgtttccagagatttgccggtgcgttccatgtcatctttcatcatggcggcgaagccgtctgacatggtcggacccggcagcacgctgttgaccgttacgccgctaccggcgacaaattttgccagtccgcgggcaagggaaagctgcgcggttttggtcacgccatagtggatcatgtccgacgggatattgagcgccgattcagaggagataaacaccacccgtccccagcgtttttgcaccatgccaggcaataatgcacgggcgaggcggacgccggacataacgttggtctgccagtagttttcccaggtttcgtcgtcggtggagtagaaatcctgcgggccataaatcccggcattgtttaccagaatatccacgccggaagccgcccgcagcaccgattccactccttccggcgtactgagatcggcaatggccgcacgcaccgccacgcccggcaccacctgctggagatgctgaataccctgatttaccgaactttcgctgcggccattcacgatcacttccgcaccgctctctgccaggccgcgggcgatagcaaagccaatcccgcccgttgaggcggtcaccagcgcgagttttcccgttaaatcgattttcatggactgctcccggtcattattgatgattcttcagaccgttaagcgtagcagttgcgtggcgcaagatgagttatccctagccaggcaaccggcttttaggacggccaggccccagcaggatcgccagcttgctgccgcctttggtggtctccatccagatcttacagacgctggtgagcggcacagagagcagcattcccaccgggccgagcagccatccccagatcagtaaggataaaaataccaccatagtcgacatgcccagacggtggcccatcatgcgcggctccaccatattccccagcaccatgtgcacgaccaggaagaggatccccaccatcataaactcgtaaaagccgttgaacaggaaggcctggatcatcggcgggatggccgagatcaccgagccgatgttaggcacatagttaagtaaaaatgccagcacgccccacatcagcgcaaactggacgcctaacagcatgagacccagccagatgatggccccggtccacaggctgatcagcgttttcagcgccaggtagtgcgacacaccttttaaggcgcggtgcaatccggcgatatggatctgcggattgttcagcgcaaagcgcagtttgtacggcagatggcgcacttcaaacagcataaacaccacggtcatcaccagcagcacaatgctcgccatagcgttcgacaggccggtcatcagcagggtggcaaaggccatcattttgtcggagtccatgcgctgtaacatgcgctccggcgacatgtgcagatgcaggaacggcatcatgtcctgtaactgcagaaccttacgcgttaattccttattgtatttaggcagcatggtgatgaattcattaaatgacgccgccagcacgccaaacagcgcggtcagcacgatcatcatgacaaccaccacaatggtgatcgcgactggtcgcttcacgccgcgacgcaaaaaccaggtcaccagcggattaagcacgatggcgaaaaacaacgccattaataactgaacaataatgtcggcggcggcatggatgcccgccagaataataaccagagcggctaatttcaggaggatatgcaagcccgctttatcgggctggggggtgatcatagtgaattccttttttcgctgtgcccgctaagtgtagtgcgttagcggggcttcgtatgacgtgcattatctgaatctgctgctgattttcagccgtcatcatgataatagtgaaacactgttgtaaaaaatgtggtgagttccatgcctgaacccgttgccgaaccggcgctgaacggattgcgcctcaacctgcgcattatctctgtcgttatttttaacttcgccagttatctgactatcggcctgccgctggcggtattgcccggctatgtccatgatgtgatgggatttagcgccttctgggcgggactggtgatcagcctgcaatattttgccaccctggtgagtcgtcctcatgccgggcgttacgccgatctgttcggcccgaaaaagattgtcgtcttcggtctgtgcggctgcgtgctgagcggcctgttttatctgctggcggggctgagcgccgccacgccggtggtctgtttattgctgctgtgcctgggccgggtgatcctcggcatcgggcagagttttgccgggaccggggctacgctgtggggcgtcggcgtggtgggatcgctgcatatcggaaaagtgatttcgtggaacggtattgcgtcttacggggcgatggcgattggcgcgccgctgggggtgctctgctaccactacaccgggctgacggggctggcggccattatcatggcggtggcggtaacggcgctactgtttgccctgagccgtccggcggtgaaggtcagcaaaggcaagccgctgccgtttcgcgccgtgctggggcgggtctggctgtacggcatggcgctggcgctcggctctgccggttttggcgtcatcgccacctttatcaccctgttttacgacgcccgtggctgggatggcgcggccttcgccttaacgctgttcagctgtgcctttgtcggcacacggctgtttttccccaataccgttaaccgcgtcggcgggctgaacgtggcgatggtctgtttcgtggtggaaaccctcggcctggtactggtggggctggctgtcgatccctggatggcaaaaatcggtgtactgctggcgggggcgggtttttcgctggtcttcccggcgctgggcgtggtggcagtgaaggccgtgccgcaacagaatcagggcgcggcgctggcgacctatacggtatttatggatctttcgctgggggtgacaggaccggcggccgggctgttgatggcatgggcgggcgtatcggtgatctatctggcggctgcggggctggtggcggtggcgctgttgctggcatggcggttaaaaaaacggcctcctgtggagaccgttgtttaactatgcgtgtccggcagagacttatttcagcacgatggtgttgataatgttctcagctgccgtttgcgcctgctgctggttttcggccggcagcgtgacctgaatggtcagcaatttgttatccactttacccagcaccacggaagaccaggcggtctggcctttggcagagataatgctgtcgagctgctgcattttctggcctttcacgtcgatggatttgttggtcaccacctgcagctgcggatcgcggctgcgctgctgatcttccagacgtttggtcagcacggacagctcttcgttgctgttatcgccgacaataacaatcaccgctttctggccggtcgcgtcagagtagacgtgcatgttgttagcctgggtgcccagtttgccgctctgatcggtcatgtctgcgggcagcgagaaactcagcttgccgtccagcagcgttactggctgaccggtcgcattggcttccgccgacgcagcctgcgccggagtcgctttatcattgttgtcacaggccgccagccccattaccagcaggccaataccgacatatttaaccagattgcgcattgacttcttcctttcgataaacggccataacggctcattcgtccatcttatcacaagttatcaggcgtacctttaactggcctgcaacgccggaatttcagatttatctgccagtcttttcaggcacatattaagcagtacgccgtacatcggcaggaagaagaccaggctgataagcaccttaaagctgtagtcaacgagcgcgatttccatccagtgttgcgccataaacgcatccggactgcgccagaaggcgataaagaagaaggcgatggtatcgctggcgttaccgaagatggtggaaaccgtcggcgcaagccaccagtggcggctctggcgcaggcggttaaagacgcgtacgtcgaggatctgccccagcgtataggccataaagctggcggcggcgatacgggcgacaaacaggttgaaatgcgccagcgcgccgaatccctgccagctacccatataaaacagcgacgaaatgatatacgacaccaccagcgccgggatcatcacggcaaagataatgcgtcgggccagcggcgcgccaaaaatacgcacggtgagatcggtggcgaggaatataaacggaaagctgaacgcgccccaggtggtgtggaaaccaaaaatggtgattggcaactgcaccagatagttactggaggtgatcaccagtaaatggaatagcgataaccagaacaacgcttttacgcgctgggattgagagaactgcgacatattgtgacctttttagtggttggggttagggaacccaattaatgcaacgtaattttataaagccgccgcatcatactgctttgactcaccattgcaatggctaattttcacgcaatcgttaacctgacttgcgtcacaaaaatggcggcgtaaactaatgcggtttttgaccggatgagacaaccatgagcgatctgtttaccacacctgaccacacccttgatgccctggggctgcgttgcccggaacctgtcatgatggtgcgcaaaaccgtgcgcagcatgcaggcgggcgaaaccctgctgattattgccgacgatccggcgaccacgcgcgacatccccggtttctgccgttttatggagcatgaacttgtggcgcaggagacagaatcgctgccttatcgctatctgctgcgtaaaggcgactagccgctgaccgcaaaaagaacccctgttgtcacattgttaaacctccgtttcattattttagcgcttttgtgaaccgcttcacccctgcccgtcacaacccaggctaatttctaagcgtaaaaataaaacacagttttaccgctgaccctaccctggagctgacccgatgaaaacgaccctcaagccgttactggcttcgctgtgcctgtccaccgcgtcattactgtttgcccctgccgtgatggcgcaggtgatcaaagccgccgacgtgcatccgcagggctacccgaacgtggtggccgtgcagaacatgggcgaaaaactcaaacagcaaaccgatggcaaattagaaattaaagtcttccccggcggcgtattaggggatgaaaagcagatgattgaacaggcgcagatgggggcaatcgacatgatccgcgtctcgatggcgccggtcgccgctattctgccggacatcgaagttttcactctgccgtacgttttccgcgatgaagaccatatgcataaagtgatcgacggcgatatcggcaaaagcatcggcgaaaagctgactaacaacccgaaatcgcggctggtgtttcttggctggatggattccggcacccgtaacctgatcaccaagacgcccgtcaccacgcctgaagcgctgaaagggatgaagatccgcgtgcagggcagcccggtggcgctggcgaccctgaaagcaatgggcgcgaacgcggtggcgatgggggtaagtgaagtgtacagcggcatgcagaccggcgttatcgacggcgcggaaaacaatccaccaacctttgtggcccataactacctgccgatcgccaagaattacaccctgagcggtcactttattaccccggaaatgctgctctattccaaagtgaaatgggacaaactcagcgccgacgatcagcagaaaatcctcaccctcgcccgtgaagcccaggccgaacagcgcacgctgtggcaggcgtataacgccgacgcggtcgcgaaaatgaaagctggcggcgtgaaattccaggaaatcgacaaggcggtctttgtgaaggcgacagagccggtgcgcgcgcagtatggcgacaaacaccaggatctgatgaaagccatcgcggatgtgaagtaattctgctgcgccagccgtccgctggcgcataacgccttgtggaggacgtatgtccgaaatctacctgaagtggatggatcgcctgtacctgctcgccatgacagtggcggggatttccctgctggtgatgaccattgtcatccccatcggcattttctcgcgctacgtgcttaaccgcggcgaatcctggccggaaccggtcgccattatctgtatggtgacttttacctttatcggcgcagcggtgggctaccgtgccggatcgcacatcgccgtcaacatgctgaccgatcgtctgccgctggcgctgaaaaatgtctgtgcgcgggtggtggatctactgatgctgctcatctccagcctgatcttctggtacagctatttactgtgtgtggaactgtgggagcagccggtagcggaattcccggtgctgacctccggggagagttatctgccgctacctgttggttcggcgatcctgatcctgtttgtgattgagcggctgctgttcggttcccaggagaaccgtccggtagtgctgattggtaaccatggttaagaggtgagagatggatgcatttgtgttgttgttcaccctcgccattctgctggcgctggggatgccggtggcctttgccgtcggcctgagcgccgtcgcaggcgcgctgtggatcgatttaccccttgaggcgctgatgatccagatcaccagcggggtgaacaaatttaccctgctggcgataccgttcttcattctcgccggcgcgatcatggcggaagggggcattgctaaacggctggtgaattttgcctatatctttgtcggctttattcgcggcggcctgtcgctggtgaatatcgtcgcctccacctttttcggtgcgatttccggctcgtcagtggccgataccgcctcgatcggcagcgtgatgatcccggagatggaaaagaagggctatccgcgcgattatgcggcggcggtgaccgccagcggttcggtacaggccattcttatcccgcccagccacaactcggtgatctactctctggcggcaggcggcacggtgtccatcgccacgctgtttatcgccggtgtgctgccgggactgctgctgggcgtctgcctgatgatcatgtgccttggctttgcccataagcgcggctacccgaaaggcgacaggatcccgtttaagcaggcgttgaagattttctttgatgcgctgtgggggctgtttactgtcgtgatcatcctcggcggtattttgtcgggaatttttacggccaccgaatctgctgctgtggcctgcctgtgggcctttttcgtcaccatgtttatctaccgtgactacaagtggagcgaactgccgaagctgatgtgccgcacggtgaaaaccgtcactatcgtcatgatcctgataggctttgctgccgccttcggtgcggtgatgacctacatgcagctgccggaacgtattaccgcgttctttacgtcgctgtcagataacaaatacgtcatcctgatgtacctcaacgttatgctgctgctgatcggcacgctgatggatatggcgccgattatcctcatcctgacgccggtgctgttgccggttaccaacgcgctggggattgatccggtgcacttcggcatgatcatgatggttaacctggggatcggcctgatcacgccgccggtgggatcggtgctgtttgtcgccagcgccgtcagcaagcagaagatcgagtccgtcgtgcgcgcgatgctgccgttctacggcatgctgctgctggtgctgggaatggtgacttatatcccggcgatctcgctgtggttgccgcgattgctggggatgcagtagtccgctaccgcttacccaacaaccgcagcgcattcgccgtcaccagcacggtggcgcctgtgtcagccagcaccgccagccacaggccggtgatgccgagcagcgtggtgaccaggaaaatggctttcagacccagcgcgatcgcgatgttctgccggatattggcatgggtggcgcgggccagctggatcatctgcgccagcccggtcaggcggttgtgggtcagcgccgcatcggcggtttccagcgccacgtcggtgccgctgcccatggcgatgccgagggtggcggctttcatggccggtgcgtcattaatgccatcgcccaccattgccagcggcgactgccgatccagcgcggtcacggcggtcaccttatcggcgggcaataacccggcacggaattccagtcccagcgcgctggcaatggccgctgccgcgcggggattatcgccggtgagcatcacgccgctgatgccaagccgacgcagggcatttacggcttcaggggcgtcttcccgcagcgtatcgcgcagcgccagggtgccgcacagcccgccatcgcgcagcacggcgatcaccgtctggccctgcgcttcctgttcctgaatttgagtaagccagctttcgtccagcacaccggcaggcagtttatccggcgcgcagataaagatagatttccccgcgacccttgcctcaatacccctgccaggcagcgtacgctgatcttccgcctgcatcagcgtcagattgcgcgcctgcgcttcctctgtgatggcctgcgccagcggatgggtggatccctgttccacggcggcggcacaggccagcagttcatcttcacccatcccctgcgccgaaacgcccactacctgcggtttacccaccgtcagcgtgccggttttatcgaacgccacctgacgaatacggcccagctgttccagcgccgcgccgcctttgattagcgctccacgacgcgccgccgccgccagcccggaggtgatggcggccggggtggagatcaccagcgcgcacggacagccgatcagcagcagcgtcaggcccttgtagatccactcgtaccaggccgctcctgccagcaatggcggcagcacggccaccagcagcgccgccgccatgatgaccggcgtatagacgcggctgaagcgatcgataaagcgctcgatgggcgcgcggcgttcctcagcttcttcgatcagttgcagaatgcgatcaatggcgctttcgcccgggcgggaaatgacttccagcgtcaccagccggtcgacgctggtcgccccggcgggaactttttctcctgcgcggcgctcaacgggcaccgactcaccggttaacgcgctttcgtcaaagctggcgaaggcggcgagtagtcttgcatccgccggtaaacgcccgcccgctgccacttcaatcacatcgccggggcgcagactgtccggtgccacggattcacgcgccgagcccgtgagccgcgtggcgctttccggtttcagggccatcagcgccgtgacgccctggcgggcgcggctggctgcccagccttcaagccgctcgccgattaaaaacagcagcaataccatggccgcttcggcggtggcgccgataaacagcgcgccgatggccgccacgctcatcagcgtttcaatggcgaaccagctgccgctttttatcagccgcagcgcctggcgggcaacggggaacagaccgaccagcgtggtggcgataaacgccagctggccgaggggatgattaacctgctccagaccccagctgatggccatcatgaccgccagcgtcagcagcggcaggttctcccgcagggtggagacgggcgggagcggggcctgcgcatcgcgcagcgtataaccggcgcgctgtacggcggtttcaatctgcgcacggacatcgcgcccggcatcgacaatcagtttttcggtggcgaaggtgacctggacctgattcacgccctcaacctggcgcacggcggtttcgactttacgggcgcaggcggcgcagtccatcccggcgacctgccaggaaaaacggctgccctgcggatcgccggatagcgatgccggtgccggatcggcatggtcagcgcagcagtttttttcaggcgcaggcgttaacgggcgcagcggggcgcgggcaaactgcggcgtttttttgacgggcggcgtgagcatggcatcctccgggaatgataattttctcattacccggaggatacactctggagtcgactccagagtcaagcattataagtagagcgatcgcacgatgaggaaatgcccggcaaagtagcaggcggcagagatggcgttgtcggcgtggaagcggcggcggtagtgactgcccagccagacgatattccccagcagcaacagcgcggcacccacaaaggcggacagggccggggccgtcggacggaagaaccacagctcgcccgccagccataccatcaccagcgtcatggcgataaaggtacagatcggccagcgcagctcctccagtcgcgtccagatcaccgcgatcaacagcgcgccaatgaccagcagcgccagcggcagcggccagaaaaaggacaacgtcatctgaccggcgaagtagatggtgtagagcagatgggcgaggaaatacgcgcctatggcgtacagcagacgctggcgcggcagcagcgtcagcgcatcaccgatcaacgaggcgcacagccccgccagcaccagatagctgatggcatcaaacatcggcgcctgccaggcaagcagcaacagcagtaataaagtgacaggtttaaatacccagcgttgccatgccggcccgcgatacgacgcgtccacatacaaccatgcggaaaaacatacagcgataaacgaccaaagcatcttaattccttgaattcgttattgtcgcgtgggcgttgcgcccacagccctgtcttcagtgtagtggtcgcgcaacgcagatggcaacgccccttcagcctgcggggagactttccgcattttctgaggcatccggtgaggattattttttgttttgcagcgctttcagacgtttttgccacaccagcagctcaaagacgccgaacagaaaaacgcgccactgttccgccgccgtcatctgtgggccatttttgggcagcgcggttttcagcatcaccatttgcaacgcatgcataaaagcggtgaataccagcgcgacgttgacgaaaatattcagcggccgcgggaaagggtggatgaggttgaggataagaaacgcccatacccccagcatcagtaaacgtcccagattaatcagcatgttgctctccttgtacggtgcggtgatacagacgataggccacctgaccggccactttctcgcgatgcagatcccagtgcacaggtacctgcggcagcccgttttccacttcgctttcgacataaatcagcgcgtcgtccgccagccagccgttcacttccagcaggcgtaaggtctcgtcgagcagccctttgcgaaacggcggatcgacaaaaacaatatcatggggggtaccggtctgattcaggaatgtcagggtgttggtgttgaccacgttggcgttagcggctttcagcgtcgccagattttgctgtaactgttgcgccacgctgcgctccatttcaatgagcgtggaggcaccggcgtagcgtgacagcgcttccagacccagcgcgccgctgcccgcaaagcagtcgaggcaacgggcattgaccatcgacggggcaagccagttaaacagggtttcgcgcacgcggtccgtcgtcgggcgcagaccagggctgtcgggcaccggcagtttacggccacgccactgtccgccaataatacgaatctggccgctggcggcacggttgggttttttcatagtgaaagctctggtcacaaatttatcccgctattttaacggcgggaagcgtggggtggaaccttaatcctcaggcggtgccgtgttgcaaggaaagtggtagactaacgaaagacttatcattacatcttactcatttttcagccccctgtttgcgacaatgcgggctgcgccatgaataaaccgcgaggagtgtagtcgcaaatggcaaaagagaaaaaacgtggcctgttctcctggttaggctttggtcagaaagaggagccgcaggaagccgcgccagaacagaaaatggaatcccaggcggttgttgaagaacaaccccctgttgaagcacaagcccctgttgaggaacagacgcctgccgaaactgcgccccattcgcagatcgaatccgaggcctttgccgcggacgtcgtggacgtcacggaaaaggtgattgagcgcgaagcgcaaccggaaatcctcgctgaagaggcggttgttgaaccggaagcggtcatcgagccggaagcgatcgttgaacctgaagcgattgtcgagcctgaggtggcggtagagcacaaagaactgccggtgccggaagagatcgcaaccatcgaaccggagccggaagcgtggctgcctgaagaaggtaccgtcgttgccgcagacgagccagagccggagcctgaggcgatcgtcgagcaggaaaaaccgactaaagaaggtttctttgcgcgcttaaaacgcagcctggtgaaaaccaaagaaaatctcggttccggatttatcagtctgttccgcggcaaaaaaatcgatgatgatctgtttgaagagctggaagagcaactgctgattgccgatgtcggcgtggaaaccacccgtaaaatcattaccaatctgacggaaggggccagccgcaaacagctgcgcgatgcggaatcgctgtacggtctgctgaaagatgaaatgagcgatatcctcgcaaaagtcgacgaaccgcttaatattgaaggcaaaatgccatttgttattctgatggttggcgttaacggcgtgggtaaaaccaccaccatcggcaagctggcgcgtcagtttgagcagcagggcaaatcggtgatgctggcggcaggggataccttccgtgcggcagcggtggaacagcttcaggtatggggccagcgtaacaacattccggtgatcgcccagcacaccggtgcggactccgcctcggtgattttcgatgccatccaggcggcgaaatcccgtaaggtggatgtgctgatcgccgataccgcagggcgcttgcagaataaagcgcacctgatggaagagctgaagaaaattgtccgcgtgatgaaaaagctcgatgtcgacgcgccgcatgaagtgatgctgaccatcgacgccagcaccggacaaaatgcggtaagccaggccagactgttccacgaagccgtcgggctgaccgggatcaccctgaccaaacttgatggtaccgccaaaggcggcgtgatcttctcggtagccgaccagttcggtattccgatccgctatatcggtaccggcgaacgtattgaagacttacgtccgtttaatgcgggcgattttatagaggcactttttgcccgagaggattaacaatgattcgctttgaacatgtcagcaaggcttatctcggcgggagacaggcgttgcagggggtgacattccacctgcaaccgggcgagatggcgtttctgaccggccactccggcgcaggtaaaagtacgctgttaaagctgatctgcggtatcgagcggccaagcgccgggaaaatctggttttccgggcatgagatcagccgtctgaaaaaccgcgaagtgccgtttctgcgtcggcagatcggcatgatttttcaggatcaccatctgttaatggaccgtacggtctttgacaacgtggcgatcccgctgattatcgccggggccagcggtgaagacattcgtcgtcgcgtatcggcggcgctggataaagtcgggctgctcgacaaagcgaaaaactttcccattcagctttccggcggtgaacagcagcgcgtgggcattgcccgtgcggtagtgaacaaacctgcggtgctgctggcggacgaaccgaccggtaacctggacgacgcgctgtcggaagggattttgcgtctgtttgaagaattcaaccgcgttggggtaacggtactgatggccacgcacgacatgagtctgattgcgcgccgctcgtaccgcatgctgagtctgagcgacggtcatttgcatggaggcctgacgggtgaataaacgcgacgcagtcaatcaaatccgccagttcggcaataaactggaccgcttccgtaaaccgggacagggcagcggcggcaaccgtggcggttccggccgcagcaaaacgccgccgaagcctggctcgcgcaagaccaacgtttttaatgaacagatgcgctacgcctggcagggcgcggtgcaggatctgaaaagcaaaccgctggcgactctgctgacggtgatggtgatcgccatctccctgacgctgccgagcgtctgctatatggtgtacaaaaacgttcaccaggcctcatcgcagtattacccgtcgccgcaaattaccgtctacttcgataagacactggacgacggcgccgcgcagcaggtggtcgggcagttgcaggcggaacagggcgtcgagaaggtgaactacctgtcgcgggaagacgcgctgggcgagttccgcaactggtcaggctttggcggcgcgctggatatgctggaagaaaacccactgcccgctgtggcggtcgtggtgccgaaaatcgacttccagaataccgaatcgctgaataccctgcgcgaccgtatcacccgcattaacggcattgatgaagtgcggatggacgacagctggtttgcgcgtctggctgcgctcaccgggctggtgggccgcgtgtctgtgatgatcggcattctgatggtggcggcggtatttctcgtcatcggtaacagcgtgcgtctgagcattttctcccgtcgcgacagcatcaacgtgcagaaactgatcggcgcaacggatggctttattctacgtccgttcctctacggcggggcgctgctcggctttagcggggcattcctgtcgctcattctgtcggagatcctggtgatgcggctgtcatcggcggtgacggaagtggcgaagattttcggcacccagtttgagctaagcggcctctcatttgacgagtgtttattactgctgctggtgtgctcaatgattggctggctggccgcgtggctggcaacggtgcaacatttacgtcactttacccccgactaaaaattctctgatatactctttccctgctgcatcggatgtctgttagcagggaaagagtccctgatctctcttttctcctgcttagcctttatcatagtaatgtcacattttgtgcgtaatctattcacaacgttgcatggaacttgtggataaaatcactgtctgataaaagtgtggatgatattctcgctgctcataagcgctggcatgtttgttgcctgaaggggacaagccgccgccagtaagaagtacattgagaggatttgaatgaccaaagaaatgcaaactttagctttagcccctgttggtaacctggaatcttatatccgggctgcgaacgcatggccgatgttgacggctgatgaagagcgggagcttgctgaaaagctgcattaccagggttcactggaagcagctaaaacgctgatcctgtcgcacctgcgctttgttgttcatattgctcgtaactactcgggctatggccttccgcaggcagacctgattcaggaaggtaatatcggcctgatgaaagctgtgcgccgcttcaatccggaagtgggtgtgcgtctggtctctttcgccgtgcactggatcaaagccgaaattcacgaatacgtgctgcgtaactggcgtattgtgaaggtcgccaccactaaagcgcagcgtaagctgttctttaacctgcgtaaaaccaagcagcgtctgggctggtttaatcaggacgaagtggaaatggtcgcccgcgagctgggtgtttccagtaaagacgtgcgtgagatggaatcccgtatggccgcccaggacatgacctttgacatgtcgtcggacgatgaatccgacagccagccaatggcgccggtactctatctccaggataaaacctctaactttgccgacggcattgaagacgataactgggaagagcaggccgcgaacaaactgaccgatgcgatgcagggtctcgacgagcgtagccaggcgatcattcgcgcccgctggctggacgaagacaacaagtctacattgcaggaactggccgaccgctatggtgtttccgctgagcgtgtgcgccagctggaaaagaacgccatgaaaaaactgcgtatcgccatcgaagcctgatctccgcaaaccgctttttgtggtttgacgtcaaagacccctggatgaaagtccgggggttttgtttttttacgcctgctctggcgattttttaccctgtggcaaacacttacagatgcgcatttcgtgtttatggcatctcagggggtcagggtgaaaaataacgaactcaatgaaagacgtttacaggccacgccgcgcggcattggcgtgatgtgtaatttttatgcggataaagccgaaaacgccacgctgtgggacgtggaaggcaacgaggtgatcgacttcgccgcgggcattgccgtgctcaataccgggcatcgtcatccgaaagtgatggccgccgtggaaaaacagctgcacgcctttacgcacacggcgtatcaaatcgtgccctatgagagttacgtcgcgctggcggaaaaaatcaacgcgcgcgtgccagtcgcagggcctgccaaaaccgcctttttctcgaccggcgctgaagcggtggaaaacgcggtgaaaatcgcccgcgcgtacactcgcaggccgggtcttatcacctttggcggcggctttcatggccgcacctatatgacgatggcgatgaccggcaaagtcgcgccctacaaaatcggcttcggtcccttccccggatcggtgtttcacgcgcagtaccctaatacgctgcatggcgtgagtacagccgatgcgctgaacagccttgagcgtattttcaaagcagacatcgcgccggatcaggtggcggccatcgtgctggagccggtgcagggtgagggcggatttgtcatcgcaccggatgatttcatgcagggactgcgcgccctgtgtgatacccacggcattctcttgattgccgacgaagtgcagaccggctttgcccgtaccggcaaactttttgccatggagcatttcagcgtcaaacccgatctcatcaccatggcgaaaagcctcgccggtgggctgccgctgtcggcggtagcgggacgcgcagaggtgatggacgcgcctgcgccgggcgggctgggcggcacctatgccggaaacccgctggcagtggcggcagccctggcggtgctggaggtgatcgacgaagaaaacctgtgccagcgcgcggcccaactgggacagcatctggtggaagtgctggaaaaagccagagcggagtgcccgcagattgccgggatccgcgcgctgggttccatggtggcggtggagttcgccgatccgcacagcggcgagccgtcgccggaatttacccgtcaggtacaggcgcgggcgctggaggccggactgctgctgctcaactgcggcgtgtacggcaacgtgatacgtttcctctatccgctgaccattccggaagcgcagttccggcaggcgctggatattattcacgcgtcgctaacccggtaaaaatgttgttacatattctgaaaaatggggtatgttttagcagagtatgctgctaaagcacgggcggcagaccaataatcgaaataaagtgctgaacaacaacatcacaacgaatgtaataaccacaataatggggattctcaggatgaaaatgaagggtaaagcgttactggcaggatgtatcgcgctggcaatgagcaacgtcgcattcgcgaaagacattaaagttgcggtggtgggcgcgatgtccggcccggtagcgcagtatggcgaccaggaatttaccggcgcgaaacaggcgatcgaagacatcaacgccaaaggcggtatcaaaggcgacaagctggttgcggtacagtacgacgatgcctgtgacccgaaacaagccgttgccgttgccaacaaagtggttaacgacggtatcaaatacgtgatcggccacctgtgttcctcctctacccagccagcgtctgacatttatgaagacgaaggcattctgatgatcacgccagctgccaccgcgccggaactgaccgcacgcggctataacatgctgctgcgcaccaccggtctggactctgaccagggcccgacggctgcaaaatacattctggaaaaagtgaagccgcagcgtatcgccgtgatccatgacaaacagcaatacggtgaaggcctggcgcgtgccgtgcaggaaaacctgaagaaaggcaacgcgaacgtggtgttcttcgacggtctgactgcgggtgagaaagacttctccacgctggtggcgcgtctgaagaaagagaatatcgacttcgtttactacggtggctaccacccggaaatggggcagatcctgcgccaggcgcgtgctgccggtctgaaaacccagtttatgggcccggaaggcgtggcgaacgtctccctgtctaacattgccggtgaatctgccgaaggtatgctggttaccaagccgaagaactacgatcagctgccggtgaacaaacctattgttgacgcgatcaaagcgaagaaacaggatccgagcggtgcattcgtatggaccacctacgcggcgctgcaatccctgaaagcggggctggagcattcagaagatccggcagagatcgccaaatacctgaaagccaactctgtggaaaccgtaatggggccactgagctgggatgagaagggcgacctgaaagggtttgagttcggcgtgttcacctggcatgcgaacggtacggcgactgacgcgaaataagaaaaccgtcaaataccatccttcctgtaaacccgctgcggcgggttttttcatttgattgcgttacgcgacaaaatgtcgcaaacttgagatgtttaaaaaaaccattgttccaaaacgatggccacaaaactggagtaccgatatggcaattagcatccggctggatgatgattttgttgaaaaagtgaaggttcatgccgacgcgcagagccgtagcgtgccgaagcaaattgaacactgggcaaaaataggacgcattgcggaagcgaatcctgaaatgtcctgggcgcttattaacgaaatcctgctggctaaatcagaaatcgacaacggacacgtcaccaaatatgtgcgcaaaaaagacaggacctgaaattgaggtatatcagtcacgtcgttttgaaaagaaatttgccgcgctgactgaacaggaacagaaagatgtcgatgagcaaatcgaactgatcctggacgatccagaacttggcgaacgcaagaaaggggatctcagtttcctgcgcgtacataagttcagaatgaataaccagctgtacctgttaggttacagctggattgaaggaaagctggagctgtatcttctaagcattggctcccacgaaaatttttatgacgagcagaaacgtcatcgcaaagccgatctgaagctcatcgtatagtctgcttccccttgcgccggtgaggggatttaccgcttctgccagccgtccgcgcgggcgctgaaacctgccgactgcataaacgcatccatcaccgttttatcttcgaccgcaatatcagacatccaccagacgctgatctccgggtgtgcgcgcagcacttcctccagcaaatacttgcccacgccacggcggcgggtgacgtcgcgtacgcgcagcgaatccagcgctccgtctttgccgcttaaggtgacgcgcaccgcagccagcagacgatcgttaaaccgtgcggcatagatgcagtggctgtcgtcaaccgccagggagtccggggagtactccggccagattttgcctaaatcgatatgatcctgttcgctgaatgtgttcagacggatgatagtcagtttcatttactgcgggtccagatcgtcaagtgagggtgcagtgtactcaatttttgcgctcaggcgctttcactttttaaatccattcatcaggcgattacttctgactcagccgtcagagtagttttaaacgtcagggatcgaaaaataagcagtattttaacctgacaggcagtgatttattccacgctttgtaccattattttatgctggcaagggcactttttttgtttatctctgaataaatacagaatattatctgttcttaatcgcctgaaaaatagggaatttagtgtggttttcagtaaaaaactacgctaaaccattaaaggcacaggtaaaaatagcattgtgcattaaatcgtcagcgttatttttaaccattaacaaacaaattttatacacaattattatgagccgccgcggggtcttccttcgccggtggccagacgtgtaaacacgacatcacgaatggggattttcaggtatgaacaggaacgcgaagacgttgatcgcggggatgatcgcactggcgatgtcgcaaaccgctattgctgccgatattaaggtagcggtggtcggggcgatgtccggtccggttgcccagtggggcgatatggaattcaacggtgcccgtcaggccatcaaagatattaacgccaaaggcggtatcaaaggcgacaagctggtcgcggtggaatatgacgacgcctgcgatccaaaacaagcggtggcggtggccaacaaaatcgttaatgacggtattcagtatgttatcggtcatctctgctcatcatccacccagcccgcgtcggacatttatgaagacgaaggcatcctgatgatttcgccgggcgccaccaatcccgaactgacacagcgcggctatcagcacattatgcgtaccgcaggcctggactcctcacaagggccgaccgccgcaaaatacattctggaaaaggtgaagccgcaacgcatcgccattattcatgacaagcagcaatacggcgaaggtctggcgcgctcggtgcaggacggcctgaaaaaaggcggcgcgaatgtggtcttctttgacggtattaccgccggtgagaaagatttctccgcgctgatcgcccgtctgcaaaaagaaaatatcgacttcgtgtattacggcggctactaccctgaaatggggcagatgctgcgccaggcgcgcgcaagcggtctgaaagtacagtttatgggaccggaaggcgtgggcaattcgtcgctgtcgaatatcgcgggcgaggcgggcgaaggcatgctggtgacgatgccaaaacgctatgaccaggatccggcaaacagcgctatcgtttccgcgctgaaagccgataaaaaagatccgtccggcccgtacgtatggatcacctatgccgctgtgcagtcgctggcgaccgcgctggaacgtaccggcagcgatgagccattagcgctggcaaaagatttaaaagcaaacggtgctaagaccgtgattgggccgctgaactgggatgagaaaggcgatctgaagggatttgaatttggcgtcttccagtggcacgccgacggttcatcctcggtagccagataacactcccaccgcccggcactgtcgggcgggaataaaaaggtttccctatgtccgagcagtttctctacttcatgcagcagatgtttaacggcgttacgctgggaagcacctacgcgcttattgccatcggttacaccatggtttacggcattatcggcatgatcaacttcgcccacggcgaggtgtatatgatcggcagttatgtctcctttatgatcatcgccgcgctgatgatgatgggcatcgacagcagctggctgctggtggccgccggctttgtcggggcgattgtcatcgccagcgcctacggctggagtatcgaacgggtggcctatcgcccggtgcgcagctccaagcgcctgattgcgctgatctccgccatcgggatgtccatcttcctgcaaaactacgtcagcctgacggaagggtcgcgcgatgtggcgctgccaagcctgtttaacggccagtgggtggtgggcagcagtgaaaacttctccgcgtccattaccaccatgcaactggtgatctgggtggtgactttcgtcgccatgctggcgctgacgctctttattcgctactcccgcatgggccgcgcctgtcgcgcctgtgccgaagatctgaagatggcgagcctgctcggcatcaacaccgaccgcgtgatcgccctgacctttgtcatcggcgcggcgatggcggcggtggcgggcgtcctgctcggtcagttctacggcgtaatcaacccgtacatcggctttatggccgggatgaaagcctttacggcggcggtgctgggcggtatcggcagcattccgggcgcgatgatcggcggcctcattctgggcgtcgcggaatcgctctcttcggcgtacctgagcacggaatataaagatgtggtgtccttcgcgctgctgattggcgtgctgctggtgatgccgaccgggatcctcggccgtccggaggtagagaaagtatgaaaccgatgcattttgcgatggcgctgctgtcggcggcgatgttcttcgtactggctggcgtctttatgggcgtgcagctgcagctggacggcaccaaactggtggtcggacacgcggcggatatccgctggcagtgggtgtttgtcggcaccgcagtggtctttttcttccagctgctgcgtccggtattccagaaaagcatgaagggcatctccggcccgaagttcgtgctgccggccattgatggctccacggtaaaacagaaactgttcctgctggcgttgctggtgctggcagtggcctggccgtttatggtgtcgcgcggcacggtggatatcgccaccctgaccatgatttacatcattctcggtctggggctgaacgtggtggtggggctgtccggcctgctggtgctgggctacggcggcttctacgccattggcgcgtacaccttcgcgctgctcaaccactattacggcctcggcttctggacctgcctgccgctggcagggctggtatcggcggcggcaggtttcctgctcggcttcccggtgctgcgtctgcgcggcgactatctggcgattgtcaccctcggcttcggcgaaattgtgcgtattctgctgctcaacaacaccgaagtgaccggcgggccaaacggtatcagccagatcccaaaaccgacgctctttggtctggagttcagccgtacggcccgtgaaggcggctgggataccttcagcaacttcttcaacgtgaaatacgatccaagcgaccgcgtggtgttcctctacctggtggcgctgctgctggtggtgctgagcctgttcgtcattaaccgtctgctgcgtatgccgctgggccgcgcgtgggaagcgctgcgcgaagatgaaatcgcctgccgttctctgggcctgaatccgacccgcatcaagctgaccgcgttcaccatcagcgccgcctttgccggttttgccggtacgctgtttgctgcgcgtcagggctttgtcagcccggaatccttcacctttgcggaatccgcctttgtgctggcgattgtggtgctcggcggcatgggctcgcagttcgcggtgatcctggcggctatcctgctggtcgtctcccgtgaattaatgcgtgatttcaatgaatacagcatgttaatgctcggtggcctgatggtgctgatgatgatctggcgtccgcagggcctgctgcccatgacccgtccacagctgaaactgaaaaccggggaagccgcgaaaggagagcaggcatgagtcagcctttattgtccgttaatggcctgatgatgcgcttcggcggtctgctggcggtgaataacgtctcgctggatctgcatccgcaggaaattgtgtcgctgattgggccgaacggcgcgggtaaaaccacggtgttcaactgcctgactggcttttataagccgaccggcggcaccatcatgctgcgcgatcagcatctggaaggtctgccgggccagcagattgcccgtatgggcgtggtgcgcactttccagcacgtgcgcctgttccgcgaaatgacggtgatcgaaaacctgctggtggcgcagcatcagcagctgaaaaccggtctgttttccggcctgctgaaaaccccggccttccgtcgcgcgcagactgaagccttggatcgcgccgccacctggcttgatcgcattggtttgttagcacacgctaaccgccaggcgagtaacctggcgtacggcgatcaacgtcgtctggagatcgcccgctgcatggtgacgcagccggagatcctgatgctcgacgaacccgcggccggtctgaacccgaaagaaaccaaagagctggacgagctgattgtcgagctgcgtaatcatcacaacaccaccatcctgctgattgaacacgacatgaagctggtgatgggtatttccgaccgcatctacgtggtgaaccagggcacgccgctggccaacgggacgccggagcaaattcgtcataacccggatgttatccgtgcctatttaggtgaggcataagatggaaaaagtcatgttgtcctttgacaaagtaagtgcccactacggcaagattcaggcgctgcacgacgtgagcctgaatatcaggcagggggaaatcgtcaccctgattggggccaacggcgcgggtaaaaccacgctgctgggcacgctgtgcggcgatccgcgcgccaccagcgggcgtgtgaccttcgacgggaaagacattaccgactggcagaccgcgaaaatcatgcgggaagcggtggcaattgtgccggaagggcgtcgcgtcttctcccgcatgacggtggatgaaaacctggcgatgggcggtttctttgccgaccgcgagcagttccagacccgtattaagcgcgtctacgagctgtttccgcgtctgtatgagcgccgtattcagcgtgcgggcaccatgtccggcggggaacagcagatgctggcgattggccgcgcgctgatgagtcagccgcgtctgctgctgctggatgagccatcgctcggtcttgcgccgatcatcatccagcaaatcttcgacaccatcgaacagctgcgtcaggaagggatgaccattttcctggtcgagcagaacgccaaccaggcgctgaagctcgccgatcgcggctacgtgctggaaaacggtcacgtggtgctggaagataccggcgacgcgctgctggcgaacgaagcagtacgcagcgcctatctgggcggttaagttttatcaggcccggcaacctccgccgggcctacacattaccttcacctgatcatcatctgcctatcatctccctgacccctgactgtcaccgttttgtaattaaaaggttatttttctgtcattcgcgcgtgtcatgttacctcgcgagcataaaacgcgtgttttcgcgcatccggcacaacaagagagataaccgaatgacttcgttacgacatacagctttaggactggcgataagcctggcatttgcaggtcaggcgatggcagtcaccactattccgttctggcactccatggaaggtcagttaggtaaagaagttgaatccctggcgcaacgttttaatgacacccatccggattacaaaattgtgccggtgtacaaaggcaactacgagcagagcctgagcgcgggtatcgcggctttccgtaccggtaatgcgccagctttgttacaggtgtatgaagtaggcaccgccactatgatggcgtcgaaagccattaaaccggtgtacgaagtgttcagcgatgcgggcatcaagtttgatgaaacgcagttcgtgccgacggttgccggttactacaccgattcaaaaaccgggcacctgctgtcccagccgttcaacagctccacgccggtgctgtattacaacaaagacgcctttaagaaagccggtttagatccggagcagccgccgaaaacctggcaggacctggccgcctataccgcaaaactgaaagcggcaggcatgaaatgtggttacgccagcggctggcagggctggatccagattgaaaatttcagcgcctggcatggtctgccggtcgccagcaaaaacaacggctttgacggcaccgacgcggtactggaattcaacaagccggagcaggtgaaacacatcgccctgctggccgatctgaacaagaaaggcgacttcagctactttggccgcaaggatgagtccaccgagaagttctataacggcgactgcgctattaccactgcctcttccggttcgctggcggatatccgtcactacgccaaattcaactacggtgtcggcatgatgccgtatgacgccgatgtgaaaggcgcgccgcaaaacgccattatcggcggggccagcctgtgggtgatgcagggtaaagacaagccgacttacaccggcgtggcgcagttcctggaattcctggcgaagcctgaaaatgcggctgaatggcaccagaaaaccggctatctgccgatcaccaccgctgcctataacctgacgcgcgagcagggcttctacgataaaaacccgggcgcggataccgcaacccgtcagatgctgaacaagccgccgttgccgttcaccaaaggcctgcgtctgggcaacatgccgcagatccgcaccattgtggatgaagagctggaatcagtgtggaccggcaagaaaaccccgcagcaggcgctggattccgccgttgagcgcggtaatcagctgctgcgccgcttcgagcagtcgacgaagtcttaatgttttcatgccggatggcgctgcgcttatccggcctacaagtggcatttagcctgtaggccgggtaaggcgaagccgccacccggcgctgttcaggaatccaatccccatgtcatcatcccgtccggtattccgttcgcgctggctgccttatgcgctggtcgccccgcagctgattatcaccatcattttctttatctggcctgcgggcgaagcgctgtggtactcggtacagagcgtcgatcccttcgggctgtccagccagttcgtcggcatggacaacttcgtcgccctgtttcatgacagttattacctcgactccttctggaccaccatcaagttcagcggcatggtcaccttctggggattgctgagttcattattcttcgccgcgctggtggactatgtgatccgcgccagccgcctgtaccagacgctgatgctgctgccttatgccgtcgcgccggccatcgccgccgtgctgtggatcttcttattcaaccctggccgcgggctgatcacccatgcgctggaagcggtgggatacaactggaaccatgcgcagaacagcggacaggcgatgttccttgtggtgttcgcctccatctggaagcagatcagctacaactttctgttctttttcgccgcgctgcaatcaatcccccgctcgctggtagaggctgccgccattgacggcgccgggccggtgcgtcgcttcttccagctgtcgttaccgctgattgcgccggtgagctttttcctgctggtggtgaatctggtatatgccttcttcgataccttcccggtgatcgacgccgcgacggcgggcgggccggtacaggccaccacgacgctgatctacaaaatttaccgcgaaggcttcgccggactggatctctcggcctctgccgcgcaatcggtggtgctgatgctgctggtcatcgggctgaccgtcgtgcagttccgctatgtggaaagtaaggtgcgctaccaatgatcgagaaccgccgcgggctgacgatcttcagccatgtcatgttgatcctcgggatcgccgccattctgtttccgctgtacgtggcctttgtcgccgccacgctgaataaccagcaggtgtttgaaacgccgatgacgctgatccccggcacacatctgctggaaaatatccgcaccatctggcgggaaggcgtgggggcgaacagcgcgcccttcggactgatgctgctgaacagctttatcatggcgttcagcattacggtcggcaaaatcgtggtgtcgatgctctccgctttcgccatcgtctggttccgctttcccctgcgtaacctgttcttctggatgatttttatcaccctgatgctgcccgttgaagtgcgtatttttccgacggtggaagtgatcgcccggctggatatgctcgacagctataccggcctgacgctgccgctgatggcctcggcaaccgccaccttcctgtttcgccagttctttatgacgctgcccgacgagctgatcgaagccgcgcgcattgatggcgcatccccgatgcgctttttccgcgacatcgtgctgccgctgtcgaaaaccaatctggcggcgctgtttgtcatcacctttatctatggctggaaccagtatctgtggccgctgctgattgtcagcgatgtgaacctcggcacagcggtggcgggcatcaaggggatgatcgccacgggagagggcaccacgcagtggaaccacgttatggccgcgatgttgctgacgctcatcccgccggtcgtcattgttttagccatgcagcgtgcctttgtgcgtggtttagttgatagcgagaaataagatggcaggtctgaaattacaggcagtaaccaaaagctgggataacggcaaaacgcagattattcagccgctgacgctggacgtgtcggacggtgaatttattgtcatggtcgggccgtccggctgtggtaaatccacgctgctgcgtatggtggcgggtctggagcgggtgtccagcggcgacgtgtggatcgatcgccagcgcgtgaccgagctggagcctgtcgatcgcggtattgccatggtgttccagaactacgcgctttatccgcacatgagcgtggaagaaaacatggcctggggcctgaaaattcgcggcatgggcaaagcgcacatcgccgagcgggtaaaggacgccgcgcgtattctggagctggacggcctgctcaaacgccgtccgcgcgaactgtccggcgggcagcgtcagcgtgtggcgatgggccgcgccattgtgcgcgatccggcggtcttcctgtttgatgaaccgctctccaacctcgatgccaaactgcgcgtgcagatgcgccttgagctgcaacagctgcaccgtcgcctgaaaaccacctcactgtacgtcacccacgatcaggtggaagccatgacgctggcccagcgcgtgatggtgatgaacaaaggcgtggcggagcaaatcggcacgccggtagaagtgtacgagaagcccgccagccgctttgtggcgagctttatcggcagcccggcgatgaacctgctggaagggcgcatcagcaccagcggcacccattttgatctcgacagcggcatgtcgctgccgattaactgggtttaccgtggctataccggtcgcaaaatgacgctgggtatccgcccggaacatattacgctaagctcacaatccgcaggcgggatcccgctggtgatggacacgctggaaatgctcggcgctgacaacctggcccacgggcgctggggcgaacagaaaatggtggtccgtctgccgcatcatgaacgtcctgcacctggcagcacgctgtggctgcatttcgcggaaaaccatctgcaccttttcgacggtgacacaggacaacgagtatgagcaactggccctatccccacattgtcgcgcatcgcggcggcggcaaactggccccggaaaataccctggccgccattgataccggcgcgcgcttcggccacaccatgattgaatttgacgtgaaattgtcgcaggacgggcagatcttcctgctgcatgacgacaatcttgagcgcaccagcaacggctggggcgtggcgggcaggctgccgtggagcgatctgttacaggtagacgcgggaagctggttcagccgcgattttacaggcgaacccctgccgttgctgtcgcaggtggcgcagcgctgccgcgagcacggcatgatggcgaacattgagatcaaaccgaccaccggcaccggcccgctgaccggcaaaaccgtggcgctggcggcacgtgaactctgggcggacatgacgccgccgctgttatcatcatttgatattgatgcgctggaagcggcgcaagaggccgtgcctgagctgccgcgcgggttgctgctggatgagtggcgggatgactggcgggcgctgacgacacagcttggttgcgtctccatccatctgaatcatcgcctgctggatgaagcccgcattgccgcgctgaaagacgccgggctgcgtatcctggtttacaccgtcaacaaacccgggcgcgccgctgaactgctgcgcgccggggtggattcaatctgtaccgacagcatcgacattatcggcccgaactttcagccttaaggactgatggttttcagcgggatattcggctgcggcgtgctgccggtgttctgattcagcatgctgccgttcgtctgctgcggcagcatgtgctgctgcgtattcagcgaggcatcgctgttatttagcatcccgccattgctgtttggcagcggctgctggcgcggcagcgtcggttcgcccggctgggactggatgatccgctgcgagttgttattaatctgcgattccagatgctgctgctgaatacgggtctgcgactgtaactgctgattcagcatgcctttttgctgtgactgctggttaagcatctgcgtctgcatccgctgctgcgacgggatctgatagtccggcagattcgggttattcatggtattaagcggctgtgcgaaagcgccaaacggcaataatgccgccagaatcaggtagggtttcatcatcatctcctctcatggggaatagcttaagtttacttgctctccggcaaaacgatgattttttaagagtagtgaaccaggcttaagcggggcctgttgctcatatctctggagaaccgcgatgatgaaacagaatgttgtgcgttgggtggccgtcgccgctctgatggcagggggatgttttggcgtggctgctgcacctccgccgccaccgccgccggtgtcatacggcgtggaagcagatgtcttccatccggtgcaggcgaaagagggcatggtggcgtctgtggatgcggcagcgacccgcgtcggcgtcgatattcttaagcagggcggtaacgccgtggatgccgccgtggcggtaggttatgcgctggcggttacccatccgcaggcgggcaatctgggcggcggcgggtttatgctgctgcgtaccaaagacgggcagaccaccgccatcgacttccgcgaaatggcgccggcccaggcatcgcgcgatatgttcttagacgatcagggtaatcccgacagtaaaaaatcccttacctcacatttagcgaccggcacgccgggcacggtggcgggcttctcgctggcgctggaaaaatacggcacgctgccgctgaacaaagtggtgcagcctgccatcaaactcgccaggcagggctttaccgttaacgacgcgctggcggaagatctgaaaacctacggcagcgaagtgttgcccaactatgaaaatagtaaagcaatcttctggaaaaacggtgagccgctgaaaaaaggcgacaaactggtgcaggctaatctggctaaaagcctggagatgatcgccgaaaaaggcccggaagccttctacaaaggcgcgattgccgatcagatcgcccaggagatgagtaaaaacggcggcctgatcaccaaagaggatctggctgcctataaagccgttgagcgcacgcccattagcggcacctatcgcggttatgaggtgttctccatgccgccgccgtcctccggcgggatccacatcgtgcagatcctgaatatcctcgaaaacttcgatctggcgaaatatggctttggcagcgccgatgccatgcaggtgatggcagaagcggaaaaatatgcttatgccgatcgctcggaatatttaggcgacccggattttgtgaaggtgccgtggcaggcgctgaccaataaggaatatgccaaatccatcgcccagcagatcgatgtgacaaaggcgaagccgtcgagccagatccgcccgggcaagctcgcgccttacgaaagtaatcagaccacgcatttctcggtagtggataaagacgggaacgccgtctcagtcacttacaccctgaacactacgttcggaacgggcattgtggcagggaataccggtatcctgctgaataacgaaatggatgatttctcggctaaaccgggcgtacctaacgtttacgggctggtgggcggcgatgcgaacgccgtggggccgggcaaacgtccactgtcgtcgatgtcgcccactatcgtggtaaaagacggtaaaacctggctggtcaccggcagtccgggaggcagccgtattatcacgaccgtgctgcaaatggtggtcaacagcattgattttgggatgaacgtcgccgaagcaaccaacgcgccgcgcttccatcatcagtggttgccggacgagctgcgcgtggaaaaaggcttcagcccggatacgctgaaactgctggaacaaaaagggcagaaagtcgccgtgaaagaggcgatgggcagtacgcagagcattatgatcgcccctgacggtatgcgatacggcgcatcagatccgcgctcggtggatgatctgacggcggggtattaacttttatgcccctcaccccggccctctcccgtggggagagggggagtatggcatcggtttatgccctctcccctggggagaggggcagggtgaggggcgctatttcatccgcgccataaacagcgcatcgatatattcgccgttacgcagcgcatattttttgccggtgccttcggtttcaaatccgtatttacgatacagcgccagcgcaggcgcattatcgacaaagaccgtcaattcgatacgttcaatacgcagccagttgtcgcacaggttgaccatctcacgcagtaacgcgctgccgacgccgcggttgcggaaatcgggcgatacgctgatgccaaaggtcgccacgtgactgcggcgcgggttctgctcgacgctcagcgccagatggcctgtaacaataccgtcaatacaggccaccagatggcgacgacccggctgtggttttagtcgctcctgccacatttccatagaaggatgcggaatttgtagcgtgtcgtgatacacctccggctgggcattcaactggcgtaatgcttcggcgtcgtccggttgtacgtggcggatcacaatatcgctcattcctttttctcctgtgggtgaattatcccctttaacatcaggtactccgcaatgtgcgtcaactgccatttttgtgactaaaccgggaagttactcaaaccaggggccgaaataatccgggtaatgttggagatggcgcgaaagagcggcgcattttcatcgagatcggtaacaatcaaatcaacgtcattcaaatcagaggctttatgcaaatgcgttaaaccaaactttgtctggtcagcaacgacgataacctgctgtgcctgacgcattatcgctttttttgtataagcatcttcttcatttggcagggtgatccctgaattcagatcgatgccctcggtgccaataaatacaatatcaaaattaaattgcttaatataatcaacagcctgtaagcctaaaaacccctgagataaactgcgatatttccccggtataacatggaggtctatcgattcgtatttagaaagcgcattcattgcaagcagcgagttggtataaaaagtacagttttcggtacggaaaatttcctttgccacggcgagggtcgtggttcccgtttcgataaatactgagcttcccggcttcaccagttgcttacaccagccagcaatgcattttttagcgtcgggatttgcttcttctttgagggacatcgggtactcagaggcgttcctttcacaggtgatagcaccaccgtaaatcaactgtattgcaccggtactcgccagcgctttaaaatcccgattgatagtcatcgtcgaaacattcagcttgcgggctaaatcctgcgtgttcacctcaccattaaccttaatggtttcaagaatatagatttgccgtttggtttgtttcatcaaactttctctcaaaggtattatcagcgcgctaatgctaattaaatacagataaaacaagaaattacacttgtttatagacatccggcaagcataaacccctcaggttcgttatttctgctgctcatctgtgaggtagagcacagttgggtgttattttgataattttgcgtgatctgctgctcacttagtgatcaaagtataacataaagcaacattttatgtttattgtgttgccttgtaacaaagtgcatagcctaaagaagcttttattatccaatcttataactctcgcaaggagggagtgttatggggaaatatacggaaatgtccagacttgccatagggcatcttggtggaaatgaaaatattagtcatgtaacccattgtgcgaccagacttcgcatagatgttataaaaagaagtcatgtaaattctgacgcaataaaaaacctaccggattgcgcaggcgtcatcattaaagataagcaaatccagattatcatcgggccaaatgtgaatgatgcctggcatgattttgttgcggtttctgggtggaaggagagtgcaggcgagcggggcagtaatgacgtagaggaagatggcccacgtaatgccgcctggtatctgaataagttcggaaactttgtttcgcccattttcatgcctgtggtaccagcaatgattgtcggcggtatgatccttgcgatacgtaatctgctaatgaactattttggtatggatatcaatagcggaacggcaaacgtattactggcgatatttcaggctggctttacctttctgccagtttatattggttatactctcgcatcgcaactgaaaatgcagcctattatgggcgcatttttaggggcggtattgctgacggaaaggataaatgatgttgctggcctgaattttcttgggataccgatcccgcagattgattacggttcagccattttgccgattattctcggtgttttcttcatgtactatgttgataaagtgctgaagaaaatcattcccgaagccgttatctactttgtaaaacccctgctgacaatgtttatcgtagtaccagtacagctaatcatactggggcctctggggacttacttaagcggtgcgataggtgatttctgtatctggttaggcgatgccgtgggtttcctttcgcaacctattctggctgcggtttatccgtatatggtgatgctcggcatcgataaagctatctctcccatttctgttcacctaatcgcaaccgttggcttcaactcggttaccgggaccatggggtttatctcgaatatttgtatcggcgcgaccgctctgggagttgccagcagtattaaaaacaataaagcccagaaaggtatgatcgcctcctttgccgtaacggcgctgtgtggtgtcaccgaacctgcattttatggcagcttgctgatgcgacccaaagtacttattggtaccgccgtgggggcagtgagtggtggggttattgctggcctgatggggcttcgctctttcgttgaaggtggatgccctggtctattaacgtttttattctttgttgataaaagtgggagcctgcattacgtaataattgccgcaattgttgctgtcgtggcgatactggtatcgttttttgccaccagaatcattttatcattagataataaaaatttgcttagccaccggactgtatctgaataagtgcgatgcaccacacattttaaataggtgaaagtgatttcttatatccggataaataaggactataaaaatgaaagtactcgttggccatttcatgacggagtcaaatgcaaatattccgcttaagaataaaatcagcgattttcttttatcattcggcgatgaatgtattgaaagaatgcatgtgggaactgttttcgctgaagcaggtattgaattaattccggcggtctatgctgatgcaggctcgtcgggcgtcataaccaaagaggcattcgactacattgaacattgtttcctggacgcgacgcgcaaccacttgcatgaaattgacggcatttatctgatgttgcatggtgccagccaggttgaaggccttggctcaggcgatcatcatatcctgaagaaaatccgtgaaattgttggcgattatatgcctgttgccgtggtatgcgatcctcatggtaatttatgtgcggattatgtgaatgccaccaccctgatccgcagctacagagagtcaccccatacagatagccttgataccgctaaacaggtggcgtcaatgctctgtaacctcctcagagagcgtcagaatattcactctgtctatcgtaaactgcctctaattctgggcggcgaacaaagcgtctcatccgacgaacctgtcaaaagtatcaatcactatatgaatgaattggaaaatgatccacggatcatgagcgtcagctggcatccaggctatatacgccatgatacggatgtcgccgggtgtgggatcgttgtggtacccgctacggcagaggatcaatcttatgctgaagagatagccgatcaactggcagattatgtgtggaataaacggcatgaatttcattataccggattaaccgcgcagcctgatgaagctttaaaaatggcactggcgtttaaagataaaccggtatttattacggattccggggataacacgacatccggtgctaccggatggaatacttatattctgcgccagtttttagaggtcggcgatctgactaaaaaagtattgtttgccaacatttgcgatccgcaaacttatcagcaacttagtcagctgggaataggtgaagaagcgcatattaaccttggcgtcgattatgatgagatgtccaaaagcgttggtcttgacgttacggttaaggcccgtggcgagctacgcggttatatgcttcatcctcatgaggcctgctatggatacagtgttaccgtctcagtaaaaggaagacctgttgatattgtggtagccagcacccggcaaacgatggcagagcaacatcagtttactggcgcagggcttgactgggatgaatatgacatcattgtcgttaagcaaggctatatttttcccgagcttaaagaaaaagggaaattatgtgtgatgtcccttacccccggcgcgacgcctcagaatacacgcgccatccctttcaaaagaattatgcgccccatgtttccgatcgatgatatttgacatattgctttgcacggtgattggtaaaagaggttaagatgaaaaaatatgacataaggcttaaaaaaatccggccacccgagaaagattgcgcaggcacgcctgtggcactcacggatgaaaccatccagcacagaaaaaacaaaatactgaccatgatgaagcaacgtggccttgagcagttggtgatctatggtgacgtggaacattgcgggaatttcgagtacctcaccggtttttttacccgctttgaagaggcgctgatggttattaacgtcgatggtgaaataaccctggtgctcggcaatgaaaatctcaacaaagtcagtaaggcgcgcgtcaaggccagggcagtgcatttatctcatttttcactgcctaatcaacccaacagaaacgataaatcgattaaagaattacttattgaagccggtattcgtgagaatgcgcgcaccggtttagttggctggaagatgtttaccgatggttcagcgatcgataaaaagatttatgatttgccttcttttatcgtcgataccattcgcaacatcgtcggcaatgaagcctgtttgaccaatgaaatcgatttatttatcggcgaaaacggtgtcagaacggtaaacaatgctaacgaaatcgcgcactatgaatatggtgcggcgttagcctccgattgtattctggatgcgatgaacgcgctggctcctggcgttaccgagcaggaattaggcgatcgtctggtgcgttcaggtcagcatacaaacattgtcaccatcgctgccagcgggccgcgctttataaaaggtaacctgtttcctggcgagaacacggtgaaatatggcgatacgatttcattgaccgtaggctatcgcggcggcgcttccagtcgcgccggatatgccgtaaacggttctaatctcttatcaaccggggcggaaaattatctggacgcgatcgcccgaccctattttgcggcctatgttcactggctggaagcgatcaccgtaggtatgcgcggcggggaactgtttgatcgtatcgacgcgatattaccacgggaaaaatatcactggtcgctttgtccggggcacctgaccgctgaagaagagtggatgtcttctcccatttacgaaggctctcagcaaacattgcagagcggaatgatcctgcaaattgacatcattccttccatccccaatcttggcggcgtttctgcggaaagcaccgtactgctggcagacaaacagttgcaacgggaaattgagtttcagtacccacagctatggcagcggatgcaacggcgcaggcattatcttatcgaaacactgggcatcaacctgtccgcggacatcttaccgatgtgcagtacagttgcttatttgcgcccctggttgctggaccatgacaccgcctttgtctgccattttttgcaaaaaggggtagacaagtgcgaatgataatgattattattgccatgcgttcagggggaccgctacggtaaacctgaaagcacgacattgctcacattgcttccagtattatcttagccagccgcgtgctggctttttttttgccatgttgtcaccccggcatttgcgctatggttatgaaagtaaccttaaaaaggacgataccatgaccctgcattgcgcatttattggatttggcaaaagcaccacccgctatcaccttccgtacgttctcaaccgcaaagacacctggcatgtggcgcatattttccgccgtcatgcgaaaccggaagagcagcagccgcagtatcagcatatccatttcaccagcgatctggacgaggtattaggggatccgcaggtaaaactggtggtggtctgcacccatgccgacagccattttgagtacgcgaaacgcgcgctggaagccggtaaaaacgtactggtagagaagccattcacgccgacgctggccgaagcaaaaaccttatttgaactggcgagaagcaaaggtctgaccgttacgccgtaccagaatcgtcgctttgattcctgcttcctgacggcgaaaaaagccatcgagagcggcaaactgggggatattgtcgaaatcgaaagccatttcgattacttccgtccggtggcggaaaccaaacccggcctgccgcaggatggcatgttttacgggcttggcgtgcacaccatggatcagatcatctcgctgtttggccgcccggatcatgtctcctatgacatccgcagcctgcgtaacaaagccaacccggatgatacctacgaagcgcagctgttttacggcgacctgaaagccatcgtcaaaaccagccactatgtgaagatcgactacccgaaatttatcgtccacggcaccaaaggctcgtttgttaaatacggtatcgatcagcaggaaaccagtctgaaggccaatatcatgccgggcgaggcgggctttgccgccgacgatagcatcgccacgctggagtacgttaatgacgctggtgaaaccgtgcgtgaagagtggcctgcggaaaccggcgactatggccgggtctatgatgcgctctacgccaccatcactgaggggcagccgaattacgtcaaggaatctgaagtaatgaccaacctcgagatcctggagcgcggctttgagcaggcctcgccatccaccgtaaccctcgctaaataagcggatttggctcctctgcacttgttcactttttttgaacagaggagtcaattttcacccactatcatcccgaatcgattacgtccacacttactccatcgaaaacagacggggtgaaaaaaatgattttcttacgcaaagcaaacgaacgtggtcatgcaaatcatggctggctggactcctggcacactttctctttcgccgattattacgatccgaactttatgggattctctgcgctgcgcgtcattaacgatgacgtgatcgacgcaggccagggcttcggaacgcacccgcacaaagacatggaaattttgacctacgtgctggaaggggcggttgagcaccaggacagcatggggaataaagagcaggttccggctggtgaattccagatcatgagcgccggtaccggcgtgcgtcactcggaatacaacccgagcgccaccgacaagctgcacctgtatcaaatctggatcattccggaaaaaaccggcatcacgccgcgctacgaacagcgccgctttgacgccgcccagggccgccagctggtgctgtcgccggatgcccgtgacggttccctgaaggtgaatcaggatatggaactgtcccgctgggcgctgctgaaagatgagcagtcggtttaccaggtggctgcagaacgccgcatctggatccaggtggtgaaaggtgaagtgtccatcaacggcaccaaagccaccacggcggatggtctggcaatctgggatgagcaggcgctctccatccatgccgacagcgacagcgaaattctgctgtttgacctgccgcctgtttgatcccgcttaaataaataacacaacctccccgtatctgcggggaggttgtctgctgtccgtgataaactggagcaatgttttcccgtttatcacacaggcacgatgaaaaagaaaagacccgtacttcaggacgttgcagatcgcgttggcgtgaccaaaatgaccgtcagccggttcctgcgtaacccggagcaagtctccgtcgcgttacgcggcaaaatcgctgctgcgcttgatgaactgggttacattcccaatcgcgccccggatattctctccaatgccaccagccgcgccattggcgtgctgctgccttctttgaccaaccaggtttttgccgaagtgctgcgcggtattgaaagcgtcaccgatgcgaacggctatcagaccatgctggcgcactacggctataaaccggagctggaagaagagcggctggaatcgatgttttcctggaatatcgacgggctgatcctcaccgagcgcagccacacgccgcgtacgctgaaaatgatcgaagtggcgggcatcccggtggtggagctgatggacagcaaatctccgtgcctggatattgccgtcggttttgataacctggaagcggcgcgccagatgacggcggaaatcatcagccgcgggcatcgccacgtcgcctatctgggtgcacgtctggatgaacgtactatcatcaaacagcgggggtatgaacaggccatgcgtgaagccggtctgacgccttacagcgtgatggtggagcaatcctcatcttacaccgccgggattgaactgatgcgccaggcgcgtcgtgaatatccgcagctcgacggcattttttgtaccaatgacgatctggccgtcggcgccgcctttgaatgtcagcgtctggggttaaccattcccggcgacatggcgattgcgggttttcacggccacgacatcgggcaggtaatggagccgcgtctggccagcgtcctgacgccgcgcgaacgtatgggccgcatcggggctgagcgcctgctggcgcgtattcgtggcgaaaccgtgacgccgaaaatgttagatttgggttttaccctgtcgccgggcggttccatttagtctgacaaatttgaagtggctcacatttattcacttctggcgcgaatggatattgcttctccgcatccccggcatgaaaatgttaccgataactgttacccgtaacaattgacctcagcacgagtgggagcaacgccttgagtacgacaaatcttgatcaccatgtctatgtcctgatgggcgtatcgggcagcggtaaatccgccgtcgccagcgaagtggcgcaccagatccaggccgccttcctcgatggcgatttcctgcatccgcgcagcaacatcatgaaaatggctgccggcgatccgctgaatgacgacgaccgcaagccgtggctacaggcgcttaacgacgccgcttttgccatgcagcgcactaataaagtgtcgctgatcgtctgctcggcgctgaaaaagcgctatcgcgatctgctgcgtgacggtaacccgaatctttcttttatttacctgaagggcgaatttgacgtgatcgaaacccgcctgaaggcgcgtaaaggccacttctttaaaacccagatgctggtgacgcagtttgatgcccttgaagagccgggcagcgacgagcaggacgtgctggtggtggatatcgatcagccgctggacggcgtggtcgccagcaccattgcggtgattaagcagtaacgccgggaagtgaaacaggtaacatcgtaagacgccgggaagggcacaagcctgcccggcttttttattagcttttcatccacgcgcggatgccgtccaggaacatctgggtggcgagcatcaccaggattagccccatcaggcgctccagcgcgttcacgcctttatcccccagcagacgcaggaataatgacgactgcaacagaatcgccacggtgccgccccaggccagcagcagggcgatgaccagatgccccatctgattcggatactgatgcgataacagcatcagcgtggcgagcagcgtcgggcctgccaccagcgggatggcgagcggcacgataaacggctcttcgcccgcaggcagcccgtggctgccgccggtcgggctgggaaaaatcatcttaatggcgattaaaaacagaatgatgccgcccgaaatcgacacggtttcagcgcgcagattcaggaatgacaggatcttctcgccggcaaacagaaaaatcagcatcaaaagcagggcgatcagcagctcgcggatcataatggcccggcggcgcttcggctccgtgtgcttgagcaccgacataaaaataggcaggttgccgagtggatccataatcaggatcaacagcaccgcggcggagatgatttcgttcatttaatactttccctaatactcgccccagattttttgcctataagctctatttctgacgacgtcgctatcattgattaatttcacttgcgactttagctgcattttgtaaggtgaagggacgccagtcggaaactggttcgcacacacagcacacaccttcgcaggaaaaatacgctatgaaaaatgttggttttatcggctggcgcggaatggtcggctccgtactcatgcaacgcatggtagaagagcgcgatttcgacgccattcgcccggttttcttttcaacgtcccagctgggtcaggccgcgccgacattcggtagcacaccggctggcacgctccaggatgcgtatgatctggaggcgttgaaggcactcgacatcattgtcacctgccagggcggcgattataccaacgaaatctatccaaagcttcgtgaaagcggctggcagggttactggatcgatgccgcctcgtcgctgcgtatgaaagacgatgccatcatcattctggatccggtcaaccaggacgtgattacccgcggcctgaacgagggcgtaaaaaccttcgtcggcggtaactgcactgtcagcctgatgctgatgtccctcggcggcctgttcgcccaggatctggtggagtgggtgtcggtggcaacttaccaggcggcttccggcggcggcgcgcgccatatgcgtgaactgttaacgcaaatgggccagctgcatcaccacgtctctgacgagctggctaacccggcgtcggccattcttgatatcgaacgcaaagtgacggcgctcagccgcagcggcgagctggcggtggacaacttcggcgtgccgctggcgggcagtctgatcccgtggatcgacaaacagctcgataacggccagagccgcgaagagtggaaaggccaggcggagaccaacaaaattctgcgtacctcgtccgtgattccggtcgacggtctgtgcgtgcgcgtcggcgcgctgcgctgccacagccaggctttcaccattaaactgaagaaagatgtgtccattcccacagttgaagagatgctggcggcgcataatgagtgggcgaaagtggtgcctaacgaccgcgacatcactatgcgtgaactgaccccggcagcggttaccggtacgctgaccacgccagtcggtcgtctgcgtaagctcaacatggggccggaatatctctctgcctttaccgtcggcgatcagctgttgtggggcgccgcagagccgttacggcgcatgctgcgccagctggcgtaagacttatattcagagcggaggtgcggtgtcacctccttttttttgcgtattacatggaggaaacgcgaatgtttcaaataagtcgggagataaacgtagtgttggctatgctttaagttgggcgtagtcccggcggaagtgaaagctgccggtacgccattcaggccaaaaaagtgccgccatccgtggtcagttcacggctgaacgctatggcacacatataaaaggatgaagaaaccatgtccagtcttgtcgatagagacgtgattaacgcgctaattgcaggccactttgcggatcccttttccgtactcggcatgcattacaccgatgccgggctggaagtccgcgcattgctccctgacgccaccgaagtttgggtgatagaaaccaagaccgggcgcaagctcgccaggcttgaatgcctcgattcgcgcggctttttcgccggcgttattcagcgtcgcaaaaatcctttccgctatcagcttgccgtcgtctggcacggtcaggaaaacctgattgatgacccgtatcgcttcggcccgctgatccaggatctggatgtctggctgctgtcggaaggcacccacctgcgtccgtacgaaaccctcggcgcgcacgccgataccatggatggcgtgaccgggacgaaattctccgtctgggcgccgaatgcccgccgcgtctcggttgtcggccagttcaactactgggatggccgtcgccacccgatgcgtctgcgtaaagaatccggcatctgggaactgtttatccccggcgcacacaacggtcagctgtataaatacgaactgctcgacgccaacggcaatctgcgcatcaaagccgacccttatgccttcgaagcgcaaatgcgcccggaaaccgcctcggtgatctgcggcctgccggaaaaagtggagcagagcgaagagcgtaaacgcgctaatgacttcgatgcgcctatctccatttatgaagtgcatctgggttcctggcgtcgccacacggacaacaatttctggctcagctaccgcgatctggcggatcagctggtgccgtacgccaaatggatgggcttcacccatctggaactgctgccgatcaacgagcatcctttcgacggtagctggggctatcagccgaccggcttgtacgcgccgacccgccgtttcggtacccgcgatgacttccgctatttcatcaatgccgcgcacgccgcaggcttaagcgtgatcctcgactgggtgccgggccatttcccggaagatgattttggactggccgaatttgacggtaccgacctgtatgagcacagcgatccgcgcgaaggctatcatcaggactggaacacgctgatttataactatggtcgccgcgaagtcagcaactacctgatcggcaacgccctgtactgggttgagcgcttcggcattgacgccctgcgcgtggatgccgtggcatcaatgatttatcgtgactacagccgtaaagaaggggagtggatccctaacgaatacggcggccgcgaaaatctcgaagctatcgagttcctgcgtaaaactaaccgcgtactgggcgaactggtgcctggcgcggtcagcatggcggaagagtccaccgacttccctggcgtctcacgaccgtcggataacggcgggctggggttctggtacaagtggaatctgggctggatgcacgacacgctggattacttcaagctggatcccatctaccgtcagcatcaccaccataatctcaccttcggcatgctgtacaactacaccgaaaacttcgtgctaccgctgtcgcacgatgaagtggtgcacggtaaaaaatccattctggatcgtatgccgggagatgcgtggcagaagttcgccaatctgcgtgcctactatggctggatgtgggctttccccggcaaaaagctgctgtttatgggcaatgaatttgcgcaggggcgtgagtggaaccacgacagtagcctcgactggcatctgctggaaggcggcgacaactggcaccacggcgtgcagcgtctggttcgcgatctcaaccacacctatcgtcatcataaagcgctgcatgagctggattttgatggctacggcttcgaatggctggtggtggatgacagagagcgctcggtatttgtttttgtacgccgcgataaagcgggcaacgaaattatcgtcgccagcaacttcacgccggtgccgcgtccgggttaccgtttcggcatcaatcagcccggcaaatggcgcgaaatcctcaatactgactcgatgcactaccacggcagcaatgccgggaacggcggcgcggtacagagcgagcagattggcagccatggccgtgagcattcactgtgcctgaccttacctccactctccactatctggctggtgcgggagggagaatgaccatactcacggcagggaagcctgagccgctcggcgcgcatgtcgtcgacggcggcgtcaacttcacgctgttttccgcccatgcggagcgcgtggagctgtgcgtgtttgaccaggaagggaatgagcaacgttatgacctgcccgcccgcagcggcgatgtctggcacggttttctggcgggcgcgcgcgccggcctgcgctatggctaccgtgttcacggcccctgggcgccggagcacggacatcgctttaatccggcaaaagtgctgatcgacccctgcgcccgtcgcgttgacggagaactgttggacgatgcgctgttccacggtggttacgagcgacccgatccccatgacaacgccgccatcgcgctgaaaagcgtggtggttaaagacgtttttgactgggaagacgacgcgccgccgcgcacgccctggggcaacagcgtgatttacgaagcgcatgtaaaagggctgacgtatctgcatccggatattccgcaagccgagcgcggtacctacaaagcgctccgccatccggccatgatcgcttacttcaaacgcctcggcattacggcgctcgaactgttacccatcgcgcagtttgccagcgagccgcgcctgcaacagctcggcctgagcaattactggggctacaacccgctggcgatgtttgcgctcgatccgcgctatgccgttgatccggaacgtgcgcggcaggagttttgcgagacggtaaaagcgctgcatcaggctggcattgaagtcatccttgacgtggtgcttaaccacagcgctgaaattgatcttgatggtccgaccttctccctgcgcggaatcgataaccgtagctattattgggtaaggggagatggtgattacgaaaactggacgggttgcggcaacacgctaaatttaaacttgccagccaccgtggagtacgccgttcagtgtctgcgctactgggtggaaaccttccatattgacggttttcgctttgatctggccccggtcatggggcgcacgccgggctacacgccccatgcgccgctgttcgaggccattgcagccgatccgctgctcagcgcggtgaagctgattgcagagccctgggacgtaggggcgggggggtatcaggtggggaattttccgccgttgtttgcggagtggaacgatcatttccgcgatgccgcgcgccgtttctggctggcaaaagatctctccctcggagagtttgcccgccggtttgccggatccagcgatgtgtttaaacaacggggtcgcgcgcctggcgcgtcggtcaacctgatcaccgcgcatgacggttttaccctgcatgactgcgtttgtttcaatcagaaacacaacgaggcgaacggcgaggaaaaccgcgacgggactaacaataaccatagtaataaccatggtatagaaggattaggcggctctctacatgtgactgaacggcgtcgggatagtgtccatgccctgctgaccacgctgctcctgtctcagggaacgcctatgctgctggccggtgatgaacaggggcacagccagcatggcaataacaatgcgtattgccaggataacgcgctgacgtggctggactggcgtcaggcaaatgacgggctgatcactttcactgcggcgctcattgccttgcgtcagcagatcccggcgttaaccctgaacgcctggtgggaagagggtgacggcaacgtgcaatggctgaacaaagacgctcagccattacgtcctgaggagtgggcgcaaggcacgggtcgaatgcagatcctgctgtcggagcgttatttaatcacgctcaacaacacggacgacgtagcgcaaatcgttttacccgatggggaatggcgtgctgttcccccatttgccggtgaggataatccggttgtaatggctgtctggcatgggcccgcgcacggaatttgcgttttcaaacggtcttaaaaaaggagttcatcatggttagattagataaaaacgatccgctaatgttagcgcgccagctcccattaaaatcggttgccctgattcttgcaggggggcgtggtacgcgtctgaaggacttaaccactacccgggcgaagcctgcggtgcactttggtggcaagttccgcattatcgacttcgcgttgtccaactgcattaactccggcatccgccggattggcgttatcactcagtatcagtcgcatacgctggtgcagcacatccagcgcggctggtcgttctttagcgaagagatgaacgagttcgtcgatctcctgcctgcccagcagcgcgtacacggtgaaaactggtatcgcggcacagcggacgcggtgacgcagaacctcgacatcattcgtcgctataacgcggaatacatcgtgatcctcgcgggcgaccacatctacaagcaggactactcgcgcatgctcattgatcatgtggagaaaggtgcgcgttgcaccgtggcctgtctgccggtgccgattgccgaagccaccgcctttggggtgatggcggtcgatgaaaatgaaaaagtggtcgctttcgtcgagaagccggaaaacccgcccgcgatgccaaacgatccgacacgggcgctcgccagtatgggcatctatatttttgatgctgactatctgtttgagctgctggaagaagatgatgcggacgacacctccagtcacgactttggtaaagacatcattccgaagctgacgaaagcgggcatggcgtacgcgcacccgttcccgttatccagcgtgcagtccgatccgaatgccgagccgtactggcgcgatgtcgggacgctggaagcctactggaaagcgaacctggatctggcctcggttacgccagaactggatatgtacgatcagaactggccaatccgtacccatatggagccgctgccgccagcgaaatttgtgcaggaccgttccggcagccacggtatgacgctgaactccctggtatcgggcggctgcatcatctctggctccgttgtggtgcaatcggttcttttcccccgcgtgcgggtgaactcattttgtaatatcgactcatccgttctgttaccagacgtatgggtagggcgttcctgtcgcctgcgccggtgcatcatcgatcgcgcctgtcagataccggaaggcatggtaatcggcgaaaacgcggaagaagacgcgcgccggttttaccgttcagaagaaggcattgtgttagtcacgcgggaaatgttgaataaactcaaaggctaacagcatcaagaataaccttgcgcggaaggggtccgcgcgctgttttaccgaacccgcaaacaggcggcggtaattaacaggagcgagaatgcaggttttacatgtatgttctgaaatgttcccgctgcttaagacgggcggtctggcagatgtccttggcgcgttacccgcggcgcaaatcgccggtggagtagatacacgcgtccttttgcctgcttttccagatattcgacggggcattaccgatgcacgagtggtgagtcgacgcgacacttttgccggtccattcactttactttttggtcattataacggcgtggggatttacctgattgatgcgccgcacctttatgaccgcccagggagcccgtatcacgataccaatctttttgcttacaccgacaacgtgttgcgctttgcgctgctgggttgggtaggcagtgaaatggcctgtggtctcgatccgttctggcatcctgacatcgtgcatgcccatgactggcatgcaggtctggcaccggcgtacctcgcggcgcgcggccgtccggcgaaatcggtgtttactgtgcacaacctggcctatcagggcatgttttatgcacatcatatggatgagatcgaattaccatcatcattctttaatgttcatggtgtcgaattcaacggtcagatctcgttcctgaaggctggtctgtactacgccgatcatattacggcggtcagcccgacctacgcgcgcgagatcaccgagccgcagtttggctgcggtatggaaggcctgctgcgtcagcggcatctggaagggcgtctttccggcattctgaacggggtagatgagaaaatctggagcccggataacgatctgcttctcgcggcgcgatatgatcgcgattcgctggaggagaaagccgaaaacaaacgccagctgcaggtggcgatgggtctgaaggtgaatgacaaagtgccgctgtttgcggtggtcagtcgcctcaccagccagaaagggctggatctggtgctggaagcgttgccgggcctgctggagcagggcgggcaactggcattactgggggcaggcgatccagtattgcaggaaggcttccttgcggcggcggcggaacatccgggccaggttggggtgcagatcggctatcacgaagccttctcgcatcgcatcatggggggagccgatgtgattctggtgccaagccgatttgagccgtgcgggctgactcagctctacggcctgaaatacggcactctgccactggtacgtcgtaccggcggtctggcggataccgtttcagacagctcactggaaaacctggcggacggcatcgccagcggatttgtctttgaagacagtaatgcctggtcgctgttacgtgcgataaggcgtgctttcgtgttgtggtctcgtccgtcgctgtggcgcttcgtgcagcgtcaggcaatgggtatggatttcagctggcaggtagcggcgcagtcctaccgggatctgtacaaccgggtgaaataatttccaggaatcgctcatatgaatgcaccttttacgtatgcatcacccacgctgagcgtcgaggcgctcaagcactcgatcgcctataagctgatgttcaccatcggcaaggatccggtgatcgccaataaacacgaatggctgaacgccacgctgttcgccgtgcgtgatcgtctggtggaacgctggctgcgctccaaccgtgcgcagctgtcccaggaaacccggcaggtttactacctgtcgatggagtttctgattggccgcacgctctccaacgccatgttgtcattaggtatttacgacgacgtaaaaaacgcccttgaagagatggggctggatctggaagagctgatcgacgaagaaaacgaccccggtttaggtaacggcggtctgggacgcctggcggcctgcttcctggattcgctggcgaccctcgccctgccggggcgtggctacggtatccgctacgactacggcatgttcaaacagaacatcgtcgacggacgccagaaagagtcgccggactactggctggaatacggtaacccgtgggaattcaagcgccacaacacgcgctataaagtgcgttttggtggacgtgttcagctggaagggaaaaaatcccgctggctggaaacggaagaaattctggcggtggcttacgatcagatcatccctggctacgacaccgacgcgaccaacacgctgcgtctgtggaacgcccaggcgagtagcgcgattaacctcggtaaattcaaccagggtgactattttgccgcggtggaagataaaaaccactcggaaaacgtctcccgcgtgctctatccggacgactccacctattccgggcgcgaactgcgcttacggcaggagtatttcctggtgtcggcgacggtgcaggacatcctcaatcgtcactacatgctgcacaaaacctacgccaatctggcggacaaaatcgccattcacctcaacgatacgcatccggtgctcggtattcctgagctgatgcgtctgctgatggatgagcataagttttcctgggatgatgctttcgaagtgacctgccaggtgttctcctacaccaaccacacgctgatgagcgaagcgctggaaacctggccggtggatatgctcggcaagatcctgccgcgtcatctgcaaatcatctttgaaatcaacgactacttcctgaagaccgtgcaggatcagtatccgaatgacaccggcctgctgagccgcgtgtccatcatcgacgaatccaacggtcgccgtgtccgcatggcgtggctggcggtggtggcaagccataaagtgaatggcgtgtccgaactgcactccaacctgatggtgcagtcgctgtttgctgatttcgcgaagatcttcccgacccgcttcaccaacgtcacaaacggcgtcacgccgcgacgctggctggcgctggcgaacccgccgctgtctgaagtgctggacgaaaatattggccgcacctggcgtaccgatttgagtcagttgcaggagcttgagcagcacattgatttcccggcggtcaaccaggcagtgcgtcaggcgaagctggagaacaaaaagcgtctggcgatcatgattgcccagcagctgaacgtggtggtcaatccaaaagccctgttcgacgtgcagatcaagcgtatccatgaatacaaacgtcagttgatgaacgtgctgcatgtgattgcgcgctacaaccgcatcaaggccgatcctgaggcgaactgggtgccgcgcgttaacatcttcgccggtaaagcggcgtcagcctattacatggcgaagcacattattcatctcatcaatgatgttgccaaagtggtgaataacgatccgcagatcggcgacaaactgaaagtggtgttcatccccaactacagcgtcagtttggcgcagatgatcattccggccgccgatctctctgagcagatttcgctggccgggacggaggcatccggcaccagtaacatgaaattcgccctgaacggcgcgctgaccatcggcacgctggatggcgcgaacgttgagatgcgggaacacgttggcgaagagaatatctttatcttcggtaacacggcggatgaagtggaagagctgcgccgtcagggttacaaaccgcgtgattactacgagcaggatgaagagctgcgcgacgtgctgacgcagatcgccaccggcgtattcagcccggaagagccgggccgttaccgcgatctggtggattcactgattaacttcggcgatcactatcaggtgctggcggatttccgcagctatgtggattgtcaggagcgtgtggacgagctgtatcgtcatccggaagagtggaccattaaagcgatgcataatatcgcggcgatgggctatttctcctcggaccgcaccatccaggagtacgccgacaagatctggcatatcgatccggtacggctgtaaatcagtacgataaacggggcctgaaggccccgttttttattatgatgctaacgacagttcgcgtttgccgtggcgcgtcagccactgcgcaatgcgcgactgctgctcagcattgagccacatcccctgcttggtacgacgccagatggcatcgtccaggcgacgcacccattcgtgctcgaccaggtaacgcagttccgcttcgtaaaactcatgcccgaaatcttcgcccagatcggccaatgaactcgcgccgccgaggatcagttcgctgttgctgccgtaagtgcgcgcatagtgacgcgccatctgctcgctgataaacggatagcgacgacgcagtttagccgcgtagtcatcgcgatcgccctgcagatcgccgcccggcagcacgcagtctttcgtccacgccgggccaatgtctttatagtaagtcgacagtttttccatcgcgtgttctgccagcttacggtaggtcgtcagcttgccgccgaataccgacagcaacggcgctttgccgttttcgtcgtgaatatccagcgtgtaatcgcgggtgatcgcctgcggcgaatcggattcgtcatcgcacagcggacgtacaccagagtaagtccagacgatatcgtcgcgcgccagctgctttttaaagtgcgcgttatagaccttcagcaggtagttgatttcgctttcgtcgatctcaacctttttcggatcgccctggtattccacatcggtggtgccaatgatggaaaactcatccatccacggaatgacaaacacaatgcgtttatcttcgttttgcaggatgtaagcctgtttctgggtatgcacgcgcggcacgacaatgtggctgcctttgatcaggcggataccgtacggtgacggcagctccatcccttcgtcgaagaactgtttcacccacgggccggtggcgttcaccagaccgcgcgcctgccaggtgtatttctcaccggtatcaacgtcttccgcttccaccacccacaggccattaacgcgttttgcggaggtggcgcgggtgcgggtcatcacttcgccgcctttgcgcacgaccatttgcgcattcgccagtaccagacgcgcatcgtccacccagcagtcagaatattcgaaaccgcgcacgatttcgggtttcattacggattctgcgccaaaacgcaaaccggcagatgcgggcaggctggtacgtttacccagatgatcgtacataaacagaccaatgcggatcatccacgccggacgcagatgcgggcggtgtggcagacgaaaacgcatcgggaaggcaatgtgcggcgccattttcagcagcacttcacgttctgccagggcttcgctcaccaggcggaactcgtagtgttcaaggtagcgcaggccgccgtggatcaatttagaactcgctgacgaggtggcgcaggcaagatcctgcgcttccagcatgagcacagataaaccccgccctgcggcgtctgccgcgataccggcaccattgatgcccccgcctatcacaatcagatctttggtttccatgttcgcctcatgcactttcgtaaaagctcaaaaatgttcgttatcgctcatgatagcaaaggaatggcgcattggtaacatcaaaaaaacaatttagagtgatatgcataacataatggcgtttacctgccgtgaagacgtaaacttgtcgctaagatgtggggccagcgtacccgccagaatttgcacaacgaaagagagcaccatggatcaatttgaatgtattaatgtggaagaaacccatcagaagctgcagcaaaagcaggcggtgctggtggatattcgcgatccgcaaagtttcgccatgggtcacacgcctggcgcgttccatctgacgaacgatacgctcagcgcctttatgcaggaacacgactacgacacgccggtgatggtgatgtgctatcacggcaacagcagcaagggcgcggcccagtatctgctgcaacagggctttgatcaggtctacagcgtcgatggcgggtttgacgcctggcaccgccattttcctggcgaggtggcgcacggatcgctttaaacctttatactgtcctcttttatgtggaataagtgcagccagcgatgttgatgatcacctcttttaccaacccgcgtatcgcccaggcgtttgttgattacatgcaaacgcagggcatcaccctgacgatccagcatcacgctaccaccgacgtctggctggcggatgaaagccaggctgaacgcgttcacgcggaactggcgcgctttttagaaaaccccggcgatcctcgttacctggcggcaagctggacgtcaggccagaccaacagcggcctgcattatcagcgctacccatttctggccacgctgcgccagcgggccgggccctttaccctggcgctggcggcgatctgtgttctggtatttatcatcatgaacgtcgtgggcgatgagccggttatggcctggcttgcctggccttacgatccctccctgcgctttgacgtctggcgttatttcagccacgcggtgatgcatttttccgtgctgcacattctgtttaacctgctgtggtggtggtatctcggcggcgcggtggaaaagcgactcggcagcggcaagctgattgtcatcaccatcatcagcgccctgctgagcggtttcatacaacataaattcagcggcccgtggtttggcggtctgtccggcgtggtctatgcgctgatgggctacgtctggctgcggggcgagcgcgatccgcaaagcggaattaatttgccgcgcggcttgatagccttcgccttagtgtggttaattgccggttggtttgatctgttcggcatgtccatcgccaatggcgcccatgtcaccggtctggttgtcggtctcgccatggcgtttgtcgatacgcaaaatgtgcgaaaacgaacataaattttccaggatatttcatgaagcagacacaacgccacgatgccattatcgaactggtgaaaaagcaggggtacgtcagtaccgaggagctggtggagcaattctccgtgagcccgcagacgatccgtcgcgatctgaatgaccttgccgatcagaatatgatcctgcgccatcacggcggcgcggcgttgccgtccagctcggtgaataccccgtggcacgatcgtaaagccacgcaaaccgccgaaaaagagcgtattgcccgcaaagtggcaagccagatccccaacggcgcaacattatttattgatattggcacgacgccggaagcggtggcgcatgcgttactggagcacagcaatctgcgggtggtaaccaataacctgaacgtggccaacacgctaaaaacgaaagaagacttccgcattattctggccgggggcgagttgcgcagccgggacggcgggattattggcgaagccacgctggattttatctcccagttccgtctcgatttcggcatcctggggatcagcggtattgataccgacggttcgctgctggagtttgattaccacgaagtgcgcaccaagcgggcgatcattgaaaactctcgccacgtcatgctggtggtcgatcattccaagtttggtcgtaacgcgatggtgaatatgggtagcatcagcatggtgaatgccgtgtacaccgacgtgatgccgcccgccggtgtcctgcaggtcatcaaggatcataatattcagcttgagctgtgctagcgaaacggggcttataccccgtatcccatcatcttcaatagctgctgcgcgtgctgcaccgcatcctgacggtgcgccacgccgagcttctgatacagattacgaatgtgcgttttgatggtggtggccgccaccgccagctcaccagcaatctgttcattgctgtagccggaatagatcagccctaaaacctgccattcccgctgggtcagcggactggtacggatcagctccggcacttccgggtgattgagcaggcgctccacaaagccttcatcgaaatgcgcgaacttgtggcgatgatgctggttaatgtcgcgaagtatgcgttgggcgcgatgcccttccagttccggcagggcgttaagctggatcagctggcgcagttgctgcgccatcgcttccccttcaatcacaaagtggctgataaagccggtgcggttagccagcgtcagcgcttccatcagcacccgctgcgcatcgcttttacgtcccgcctgccagtaaagctggttcagcagcagcaggttgcgattcagatcgctcatcagccgcagactgcgcgcgttttcgtttaactcttccagcaccatctccgccggatcgaaatcaccgagcaggatctgcgcgcgggcgatgttgcgccactggctttgcaggaaatggttatcggcgaattccggcttcggcgtctggcgcagccactgggctgcggcatttttgtcgccaatcatctgccagtaaatcacccgtactttatcggcgttggatacccagtcgctgtgatactggccgttaccgagcaggttttccagacggttaagatggctgcgggcgttgtccagatcgccgcgcgccagagagttctgcaccagcagcgccagacactgcatctgctgctgcggctggtaggcggcgagtacgttcagcccttcgcgggcggcggcttccgattcatccagacgcgcccacgcccacagcagttgcgcgcggatgcgcagtaaaaactcgtgcagcggcaactgctcaagatgctgctcgcggatcagcgcaaaggctttttcctgcgtttcccaggcggcctgtaaaaagccctgggcgaacagaatttcgctctgctggatgaggctccacagcgcgtaatgccagacgtcgtggcgacgcgccatctgctcggtctgctgcatcaccgccagcgagttggtcagctgtcctttgcaatgcagcacttcaccgtgtaccgaggtggcgacgatacggctgtagtaattcgccagcggcagctcttccagcgccacggtcgacaggcgctcggcttcggcgggatcgccggcgttaatcgccacctgcgcgcgcagggcgttgaaatcaccgtgcagggagcgatccatttccatgtccatctcctgctcggcgcgggccagcagggtgttcacttcgctgtagcggtactggctttgcatcagccacgcctgaagcagcaccaggcgcggattctccagcaggctttcccagggcagcgctttcagggattcttccagcagcgccagttcgctgtggttaaacagcccccaggcgtgatgcagcaggatgtcgcgcagcatgttgccatcgcccgcggccagcgcgtgatgaatggcttcgctggggaagccctgcgccatccagctttccgccgccgcgcggtggatctccggcagctcggtcgccagctcccactgacagcgctgacgcaggaagttaccgaacagcgggtgatagctgaaccattcaccggaatcatccatccgttgcagaaaaaggccctgacgttcgatctcttccaggcgcatctgcccgttttcttcgcccgtaacacgcacaatcagcgcgtcgttcatcgagcgcagcagggaacttttcagcaacaaatgacgggtactgagatcgatattatccagcacttcatccaccagataatcggaaagatggctggcattgatccccgcgaggcggcgcgcggactggtgcgcggcatggttattctggcgggcggagagggcgatgagctgtagcgcggtggcccagccggccacatcgtcgcacaggcggctgctctctgccggttcaatgggggattccaggcgacaatcaaaaaactgcttggcttcctgatgggtaaaggccagatgctgactgccgatttccagcagttgatcgcgtacgcgcaggttggcgatacccagttgcggcagattacgcgacagcaccaccagtgtcaggcattccggctgatggcgcaggaaaaagcgcatggcgtcgtggatcaccggattagtgaccaggtggtaatcatcaatcaccagatagagtgggcgatcccagtccgccagctcgataaacagctgggcaaacagcgacgacaggctggcgtactggcctttctgggcaatggcttcgctggtgacgcagtggccgtgggtggcctgctgcaccgccgccatcaaatagctggcaaagcgctcctgctgattgtccccctcatcaagagaaaaccatccgagatcgcttttccctgcggcccactgcgaaatcagggtcgtttttccataaccggcaggacttgtcaccagcgccaggcgaaaattgttggcgcccgcaagtttagccagcaatcggtcgcgcaccactgtgtggtcaaggcgaaccgggcgacttaatttagacggaatcaacatagtcatcacttcactgtgaggtaacgggaaaggcgattttttttgcgcttcgtaattaataaagaatacgttcggccagaatgacatgtattgcaagttatgtccgaatttgaccgcgcttaatttgcactgtgtcacaattccataacctttatgaatattacctccgacagccagccatggcgcatgaacactgaatcggcgataaagcgcgcaaacgaaaaaatgcgcttttttgactcgcagcgaatttaaatattatgaaaatcgatgtcagcttatgtctgccagaaatagccgtgacgcggtttaaattttcagcaaaataataaatttttcgcattgtatttacccgcagcagataattcccatgaaacgacatttcaattttttgagcatgttccgggttatcggcgaatgaccacggcagaatgcccgcatacaaggatgctaagtggccgcgatcacacttttcgctcctccccgctactcctccctttctaatccctggcaggatgaggtagccgaaacgggagccaggcacactagcactaatgttgttttttacttacaggatccgagttccctatgtcacagcccacatttaacacagcacaattcgaagcggccctgacgcgtcagtggcagcgttttggtcttaatgccgcagaccagatgacccggcagcagtggtggcacgcggtcagcggcgcgctggcggaattactgccggtacaggcagaagccccggccaaaaaccagcgccacgtgaactacatctcaatggaatttctgattggccgcctgaccggcaacaacctgctcaacctcggctggtatcaggaggtgagcgatgtgcttcaaacccataacgtcaacctgacggatttgctggaagaagagatcgatccggcgctgggcaacggtgggctggggcgtctcgctgcctgcttccttgactccatggcgacggtgggccaggcggcgactggttatggcctgaactaccagtacggcctgttccgccagtcttttgctgacgggcagcagcaggaagcgccggacgactggcatcgcggcagctatccgtggttccgtcacaatgccgcgctggatgtgcatgtgggcatcggcggcaaaatcagcaaagacggccactggacgccagccttcaatcttatcggcgaagcctgggatctgccggtgctcggctaccgcaacagcgtcgcgcagccgctgcgcctgtggctggcaaaacatgcccatccgttcgatctcacccgttttaacaacggcgatttcctgcgtgccgaacagcagggcatcgacgccgaaaaactgaccaaagtgctctacccgaacgacaaccatctggcgggcaaaaagctgcgcctgatgcagcagtatttccagtgcgcctgttcggtggcggatattctgcgccgtcatcacctcgccgggcgtaccattgcgcagttgccggacttcgaagtgatccagcttaacgacacgcacccgaccatcgccattccggagctgctgcgcgtgttgatcgacgaacaccagctcagctgggacgacgcctgggcgatcgccggcaaaaccttcgcctacaccaaccataccctgatgccggaagcgctggagtgctgggatgagaagctggtgaaagcgctgctgccgcgccatatgcagatcatcaacaccatcaataaccgctttaaatcgcaggtggagcaaacctggccgggggacaaagacgtctgggcgaagctggcggtggtgcataacaaacaggtgcgcatggcgaatctgtgcgtggtgagcggctttgccgtcaacggcgtggcggcgctgcactcggatctggttgtcaaagatctgttcccggaatatcaccagctgtggccgaataaattccacaatgtgaccaacggcatcacaccgcgccgctggatcaaacagtgcaacccggcgctggccgcgctgctcgacacgacgctgaaaaccgaatgggccaacgatctcgaccagcttcagggcctggaaaaatatgccgacgacgcggcgttccgcgcgcagtaccgcgatatcaaacgggccaacaaagtgcgtctggcaagctatgtgaaagcgcgcaccggcattgagatcaatccggaggccatttttgatattcagatcaaacgtctgcacgagtacaaacgtcagcacctcaatctgctgcatattctggcgctgtacaaagagatccgcgaaaacccgaccgccgaccgcgtgccgcgcgtcttcctgtttggcgcgaaagccgcgccgggctactacctggcgaaaaacatcatcttcgccatcaacaaagtggcggaagcggtcaacaacgatccccgtgtcggcgacaaactgaaagtggtattcctgccggattactgcgtgtcggcagcggaaatgctcatcccggcggcggatgtttccgagcagatttccaccgcgggcaaagaggcctccggcaccggcaatatgaagctggcgctcaacggcgcgctcactgtcggtacgcttgatggcgcaaatgtcgaaattgccgagcaggttggcgacgataacatctttatcttcggccatactgttgaacaggtgaaggcgctgaaggccaaaggctacgatccgctgaagtggcgcaaaaaagacaaagtgctggatgcggtgctcaaagagctggaaaacggcgtctacagcgatggcgataaacacgccttcgatcagatgctgcacagcatgggcaagcagggcggcgacccgtatctggtgatggccgacttcatcgcctatgtcgacgcgcaaaaacaagtggacgtcctgtaccgcgatcaggacgcctggacgcgagccgctattctgaatactgcccgctgcggcatgttcagttcggatcgctccatccgtgattatcagacccgtatctggcaggccaaacgttaaggaaagccatggaaagcaaacgacttgatgccgccgcgctggcggcggggatcagccctcattacatcaatgctcacggtaaaccgcagtctattggtgcggaaactaaacaacgtttgctggacgccatgcatcgcccggccgccccgaaaaagggggcggttccgcctgtgccgccggtgaagatctttacccacggcaaaaaaatgccgctgcctgttgaaggcagcggggaattcagctggcggctgatcaccgaagagggccgggagtacaccggccaggccaccggcggtaaagcgctcaatctgccggcaaagctgccggagggctatcacacgcttgagatcggtaaggcgaaacagcaatggcagtgtcgggtgatagtcgcgccgaagcgctgctatgaaccgcaggcgttacacgaagggaaaaaactgtggggcgcctgcgtgcaactctacaccctgcgttcggaaaaaaactgggggatcggcgattttggcgatctgaaggccatgctggtggatgtggcgaagcggggcggctcttttatcggtctgaacccgatccacgcgctctacccggctaacccggaaagcgccagtccgtacagcccgtcatcccgccgctggctgaatatcgtctatatcgacgtgaacgccgtggaggatttccagcgcagcaaagaagcgcagaaatggtggaaactggcctccacgcaggatgcgctgcgcgctgcgcgcgacgccgaatacgtggattacgcgaccgttaccgcgttgaaaattgccgcgctgcgtctggcatggaaaggctttgccgcccgtaaagacagcgatgcgcagaaagtggcgttcaacgactttgttacgcaggaaggcgagagcctgtactggcaggcggcgtttgacgcgctgcacgcgcagcaggtgaaagaagatgagatgcgctggggctggccggcatggccggaaggctatcagcgtaccgacagtccggaagtgaagcagttctgcgaagagtacgccgacgaagtacagttttacctgtggctacagtggctggcctgcgagcagtttgcgcagtgctgggaaaccagccagggcttcgccatgccgattggcctgtaccgcgatctggcagtgggcgtggcggaaggcggcgcggaaacctggtgcgatcgtgaactttactgcctgaaagcgtccgtcggcgcaccgcctgacattcttggtccgctcggccagaactggggactgccgccgatggatccgcacgtcatgacggcgcgcggctacgagccttttatccagctcttgcgtgcgaacatgaaaagctgcggcgcgctgcgtatcgatcatgtgatgtcgatgctgcgcctgtggtggatcccgtacggcgaaaccgccgatcagggggcgtacgtgcagtatccggtggatgatttgctgtcgatcctcgccctggaaagcaagcgccaccagtgcatggtgattggcgaagacttggggacggtgccggtggagattgtcagcaagctgcgcgacggcggcatctactcctacaaggtgctctatttcgagaacagcgaaaacgtcttcctgccaccgcaaaaatggccggaacagtcgatggccgtggcgaccactcacgatctgccaacgctgcgcggctactgggaagccggtgatttaaccctgggcaaaaccctgggactgtatccggacgaagaggtgctgcgcggtctgtaccaggatcgcgagcgggcgaaacagggtctgctggaggcgctgcacaagcagggttgtctgccgaaacgtgccgggcacaaggcctcacgtatggcgatgaccagtacgctgaaccgcggaatgcagcgttatatcgccgattccaacagcgcgctgctcggcttgcagccggaagactggctgggtatggccgcgccggtaaatattccgggtaccagttctcagtacaaaaactggcggcgcaagctgaataccactcttgagaagatgtttgccgatgacggcgtgaacaggctgattaaggatctggacagaaggcgtaaaacggcagggaagaagtaagtattacattgcccctctccgtccggagaggggcaatagacagccgttaaatcaccgtagccagcagcagacaacccaccagaccacagaccgaaataatggtctccagcgccgaccatgacttcatggtttcaccgatagtcaggttgaagtactccttgaacagccagaaacccggatcgttcacgtgggagaaaatcacgctaccggaacccacggcgataaccatcagctcagggctgacgccggtggtggcgatcagcggtgcagcgatgccgccagccgtgatcgccgcaaccgttgcagaacccagcgcaatacgcagtactgcggcaatcgaccaggccataaagatcggcgataagttagtggagtgcatcatcgcggcaatgtatttatccacgccgctgtcgaccagcacctgtttgaacgcgccgccgccgccgatgatcagcagcatcatggcgatgattttaatggaagaagtgatggtatcggtcacgtcatccattgaacggccacggttcaggccgaaggtgaagatggcgatcagcacggcaatcagcgtggccataaccgggtcgccgaagaattcagcgtaaggcagcagcgcatggcctttcggcagcaccatttctgcaatcgcacggcccgccatcaggatcaccggtaccagagaggtccagacgctgacgccaaagctcggcatttcggcttcgctgaaggttttcgcgttgtacaggccttccgggatcggtttatcaatatttttcaggaaacgggcatacaccgggcctgccaggatcaccgtcgggatcgccagcagcgtaccgtagagcagggttttacccatatcggcgtggaagatagtggcgatagcggtcgggcccgggtgcggcggcaggaagccgtgcgttacggaaagcgctgccgccatcggcacgccgacgtaaagcagcggcacgcgcgcttttgcggcgatggtgaacaccagcggcagcaacagcacgaagcccacttcatagaacagggcgaaaccgacggtaaaaccggttaataccactgcccactgaatgtatttctgaccaaatttgtcgataagcgtggtggcaatgcgctgcgccccaccgcagtctgcgagcagtttgccgagcatagcgccgaagcccatgatcagcgcaaggctgccgagcgtaccgccgacacccgctttaatggaggcgatcactttgtctactggcatgccctgcatcagtccgacggcgagcgccaccaggatcagggcaataaatccgttcagtttaaaacggatcattaacaacagtaacaagacaacaccgatagcaacgatgactaatggcatgatttacctggcctttaatttgttatgggtaacgttaaacaccttactggcgttaccaattatcccgcagggggaacagagaacgcatcgcactgccccggcttgcttttagatttgaacaaaagtttagctggccgtttggggttaatgcagtactggcgcgaatgatacgggtaacatataaggaatgagaatgaccctggcggtttaaatgtgagaattgcgaggtgggtcaaattctggggaaaaggatgttaaatttttggtggcgggttgccgggtggcgctgcgcttatgaagcctgtaggcccggtaagcggagcgccaccgggcggggaacgtattaacacgtaggcccggtaagcgaagcgccaccgggcgggggagtgcatcagtagtaggagtgttcgccgcgctggtgttcggtcagatcgcgcacgcctttcagttccgggaactcgttcagcagctgcttctcgatcccttctttcagagtcacatcgaccatcgaacagccgttacaaccgccgccgaactgcagaatggcatagccttcttcagtaatttccatcagcgtaacgcggccaccgtgaccggccagctgcgggttaacctgcgactggatcatgtaatcgacgcgctccatcagcggcgcatcatcagacactttacgcattttggcgttcggggctttcagcgtcagctgtgaacccagctgatcggtaacgaaatcgatctccgcatcatccagatacggcgcgctcaactcatcgacatacgccgtcagcaggtcaaatttcagggcggtgtcagaagcttccactgcgtccggcgggcagtaagagacgccacattcagcgtttggggtacccggattgatcacaaatacgcggatttgtgttccttcttcctgatttgccagcagtttggcaaagtgcgcttgtgcagcgtcggaaatatggatcatagcaatggcctaatagttgactattttacctggttataatacgcccatcatcgaggctctacaaggttcgacacaggcaccatacctgaacagtcgccgcgccgccccgtaaaagcagctgagcaatctctgcgacggtgctgccggtagtgacgacatcatccacgatagcgatatggagtccgcgcaccggtaattcaaggcgaaaggcatgacgcagattatgtttccgccgtctggcgctgagctgatgctgaacgggcgtggcgcgaacgcgtatcagcgccgtgctgtcccaggcgcaggtcagccagcgggcgagcgggcggcagagcagatcgctctggttaaatcctctgcgccaccggcggcggcggtgaaggggcacgctgatcagtctgtcgggccagggcgatccccgctcacgatgggcgcgggcaacggccaacagcaacagacgcgccagcgcccgggccacttccggctggcgggagaacttcagccggtggatcaacgaactgagcggcggcacatagtcgtttaccatcaccagttgctgccagggcggcggtttttgcaggcaacgcccgcacggcaggccggaaagcgccgctggtaaaccgcactgcgggcagacggtctgcgtgataaacagcgcacggcagcacaccgaacagatgccccaggacgcgagcgccagcggcattcggcatagccagcataagccaggcactgatagcatagatcccctccctgttgatgaaagagaagcctaactgatgaatgacctgtggtgggaaaccaaaggcgaaggaaagtgtcatcttgtgctgctgcacggatggggactgaatgcgcaggtatgggattgcataacggcggaactcgtgccgcattttacgctgcatctggtggatctgccgggatacggtcgcagcagcggctttggcgcgctgactcttcagcagatgacagaggcggtgctggctcgcgcgccggacagcgccatctggctgggctggagtctgggcgggctggtggcaagccaggcggcgctcagcgccccgcagcgtgttcaggcgctggtaacggtcgcgtcttccccttgcttctgcgccgaagatgactggccgggtatcaagcctgaggtgctgtccggctttcagcgtcagctgagcgaggattttcaacgcaccgtggaacgtttcctggcgctgcaaaccctgggcaccgaaacggcccgtgcagatgcccgcaaactgaaaagcgccgtgctggcgctgccgatgccaggcgaaaccgtgcttaacggcgggctggagatcctcaaaaccgccgatctgcgcgcgccgctggcttcgctgaagcagcctttcctgcgcctgtacggtcggcttgatggcctggtgccacgcaaaatcgtggcgaggctggacgaggcgtggcccgccagccagtcggtgatcttcccgaaagccgcccatgcgccctttatttctcacccggaagacttttgtcaggcgctgctcgattttaaggcctcgctggcgtgatccctctccggcgtgtggcgaaatagtcaactggcgttaatacttaaggatgtcactgcggctttgttggtgaaaagcgtaatgacctaagaaccacaaccttaaaggagttaagcctatgaaacttgctaccggtattgtcgcgtctctggttattggatcgctgtcatttggcgtgcttgcagcagaagagttgcagaaagataaagtcaaagagatgaacctgaccaaaattggcacagtgaccacctctgacaccactgcgccgatggatgcgaaagcggaaatcgtgaagaaagccgatgagctgggcgggaaatattatgttgtgaccagcggtgataaaacgggcaaagacatccacgctaccgcagacgtgtataaataacagcagcaggcggatccccgatccgcctgtctgtcagccaggcatccaccactcccgcagacaggcttttccttccggacactgacggcactgcccgctcagacagccgccggactcttcctgaacgcgccggacttttcccagcgcctccatccggctcagcatcgcttccaccatcgacagcggtgtatgcagcgcagcgctcagggcgctggcctccattttgccgtgcagggccagcatatcgcggatctcaaacagtgaggccatggcgtgtctccttagtgacagtcgctgccggtgctggcttcgcagcagcgggcaagctgtttacgcgtcgccagcagatcgacgttcacccggcttctggcgcgacgcaggccgccaatcaccagcacgttaaacaggatcaccgcgaggatgcagaccaggctatagtgcgggtgctggctaaaggtggtcgtctgataaaacaccgttgagagcgaataagcgatattcagcccccagaggatcgagaagcccatccagccgcggctcgcttcgcgagcgatggcccccatcaccgaaatacaggggatgtagagcagcacgaagatcagatagctgtaggcggcggcagggctgccaaacttctcgctcatcacgcccatggtgccggtggccatttcgccgtcgcctttgctggcttcgatcggattagccagcgtgctcaggcttaaggtttccaccaggctttgccaggtttcttgcgcggcgcccagcagttcgtccgtcaggctgaactgcgcggcatcaaagggcgcgtcctgaatgttttcggcggtgtagagggtgtttaatgtcccgaccaccacttcttttgccatcgcgccggtaaacaggccgacggtggcctgccagtgatcgccctgcacgccgataggttccagcagcggcgtgaacacgcggctgactgaggcgagcgccgaatcgttaatactggtagccgcctggccgccgagggtgaagctgttcagggcgctgaggaaaatactgaccaccacaatcaccttacccgcgcgcagcacaaagcctttcagacgctgccaggtttgcagcagcaggcttttcagatgcgggacgtgatacaccggtagctccatcacaaaaggcgaggcttcgccgcgcataatggtgtgcttgagcatcaggccggtgagaatagccatcacgatccccagcacatagagcgagaacaccgccagcgcaccctgctgcccgaagaaggctgaggcgaacaccgcgaagatcgccagccgcgcgccgcaggacataaagggtgccatcatgatggtcatcaggcgctcacgcggcgcatccagcgtgcgggcgcccattaccgacggcacattacagccaaagccgacaatcagcggcacaaaggatttgcccggtagccccagcgactgcatcaggcgatccatcacaaaggccgcgcgcgccatgtagccggagtcttcaaggaatgacagaaacaggtacatcatgccgatctgcggcaccagcggcagcacggtgttgataccgccgcccagcccctgggcaaggaaaatggtcagccagtccgggaaatgcagcgtgtaaccaatccactgaataccgtgaatgaaaatggccacggaaccggcgtcaaagatcggcgccagcgcgccgccgatgttaatggccagcacaaacatcacgtacatcaccagcaggaagatcggcagcccgagcagacggttgaggacgatcttatccatggcggcggtaaagcgccccggctccgccgttaacgtgttgctcaccgcatcgcaaatggccgcgatggtctggtaacgggcgtcggcgatgtgcagggcaggatcgtccatctcctctttcagacgcgccagcgcctgcggcagatgctgcgccgcatcgcccgcgtagccgcggctgtagatatcgccttccagcatctgcaacgccagccagcgacgctgttgttccggcatctgtgtatccatggtttccgccagcatggcggcttcccgcagcaggggacgcgcataatgcaccaggctgatagcctgattctgctggtggcggtcaatcgccagcttaagggcgtcgatgccgcgcccgcgcgttgataccagcggcaccaccgggcaacccaggcgggcggacagggcatcgatgtcgatgcggatctgctgtttctcggcaatgtcgagcatgttaagcgccacgatgcagggaatgcccagctccagcagctgtagcgtcaggtagagattacgctccagatttgacgcatccaccacgttgatcagcatgtccgcctcgccgctcagaatgtagtggcaggcgatctgttcatcgagggaggtttgcgatgaaatggtggtcagagaataggtgccaggcagatccaccagggttaccgcgtggtcagtggtggagaacagcccttctttacgctccaccgtgacgcccgcccagttaccgacacgctgacgcgcgccggtaagctgattaaataaagttgtcttgccggaattaggattgccaattaaaccgagggttaattttttcatagtattgctgcgctctgtgagtcagtcgcttattaacgggataccgcttccacttctaataacgccagatctttttttcgtaataccaggctgacccgacgggtttcaatatgtacagggtcaccgaagggcgcgacgcgcaccacgttaaatgacgagcccggcagcatgccaagcgaaagcagtttctgacggtaagccgcgctgatttcaggggcgaaaccggtaattttccacgcgctgtcaggtgagaatgccataaggacctacttaattttgcaaatcagggtagtgtgccgggcgtcgtcaacattcaggaaaagcggaataagcgaccccggcgtcggtgacaaaataatcaactgaaagaatggtaatgagaatggtttttatcatcaacggataaaatgtgtgtgaatgttatattgacgattaatatgcgggacttttgatttagctcaaaaataagcgcggaaatgattttagttaaatggaaccagaattaacgcattgtgttaataatgtgaaaaatagtgatctgttaagttttattaattatttaaagttaattccctctcccgcaggagagggcgaaaaaaagattaacgttttttacccatggccgccgccagcgcatccatcatcgcgctgttgccggatggctgagcatcacgaccgcgtggttttgccgccccgcgcgctgccgggcggctggcctgttcgcgctgcgggccactgccgcgacgggaactggtttcgcctggctgttcgtcaagacgcatggtcagggcgatacgttttcgcggcagatcgacttccatcaccttcactttgacgatatcaccggctttcaccacgctgtgcggatcgtcgacaaacttgttggacagcgaggagatatgcaccaggccgtcctgatgcacgccgatgtccacgaatgcgccaaagttggtgacgttggtcaccgcgccttcaaggatcatgcctggcagcaggtcgttcatggtttccacgccctcggcgaaggtcgcggttttgaattccggacgcggatcgcggcctggtttttccagctctttgatgatgtcggtcaccgtcggcacgccgaaacgctcatcggtgaagtccgaggctttcagctgacgcagctcgttgccgttacccatcagatcgcgcaatgactgctctgtggcggccagaatgcgctccaccaccggataggcttccgggtgcaccgttgacgcatccagcgggttatcgccgtggttaatacgcaggaagcccgcgcactgctcgaaggctttcggccccaaacggctcaccttcagcaactgctggcggttctggaactgcccgttctcatcgcgccaggcgacaatattctgcgccatcatgcgggttaaacccgccacgcgggttaacagcggtacggaggcggtattcagatcgacgcccacggcgtttacgcagtcttccaccaccgcatcgagcttacgcgccagctgtgactggctgacgtcgtgctggtactggccgacgccgatggatttcggatcgattttcaccagctccgccagcggatcctgtaaacgacgggcgatagacaccgcgccacggatggagacatccagatccgggaactccagcgccgccagttctgaggcggaatagacggatgcgcccgcttcgctgacgatcactttttgcgccgtgactttcgggaactgcttttgcacgtcgaggaagaagcgctcggtttcgcgggaagcggtaccgttaccgatggccaccagctcaacgttatgtttttcgcacagcgtggcgaccactaccgccgctttcgcagcctggccggtgtgcggatagatggtgtcggtcgccaccagcttgccggtgccgtcaaccaccgccactttcacgccggtgcgcaggccgggatcgagacccatggtggcgcgcagacccgcaggggccgccatcagcagatcgtgcaggttacgggcgaacacgttaatggcttcgtcttcggcgcgctcacgcacggtgcccattaattccgtttcgaggtgcatcagcaccttgatgcgccacgtccagctcaccacgccacgccgccagctgtcggcaggggcgttgttcaggcgcaggccgagatggtcgatgataatctgttcgcaatggctctctttgggcggctcatcaaactgcggatcggcgttcagcgccagttgcagaatgccttcattgcggccacggaacatcgccagcgctcggtgtgacggcacgctgctaataggttcgtgatgatcgaaatagtcgcggaatttcgcgccttcttcctctttgccgctaatcaccgtcgccaccaggtgcgcgttcttccacaggtagtcacgcactttcgccagcagcgccgcgtcttccgcaaagcgctccatcagaatataacgcgcgccatccagcgcggctttggtgtcagccacgcctttatccgcatcgacgaatttcgcggcttcagtttccgggtgatgggacggatccttccacagcagatcggcgagcggttcgagtcccgcttcaatggcgatttgcccgcgcgtacgtcgcttaggcttatagggcagatagagatcttcgagttcggttttgctcagcgtactgttgatggccccggccagctcgtcggtcagcttgccctgttcgccgatggatttgaggatcgcctggcgtctctcttccagttcgcgcaggtagccaagacgggtttcgagctgacgtaattgcgtgtcgtccagaccgccggtgacttctttacgataacgtgcaatgaacggcacggtgttcccttcatcaagcaggcgaacggcagattctacctgttcagctctcgcctgaagttcacccgcaataatgcggcagagcgaattattcatcatttcaatatcatcttctgagcaaaaacagccgatagttatacggattgaggcagcaaaatgccagccgtaacgggcggcttagggattattctggcgggctattttacataggtgatctcattcacataccaggtggcttcaccgcccggcgtctgcaccacggcgacgtcgccaacctctttcttcagcagcgcgcgcgccatcggcgagtcgatggagatgtaatccttttgaccaaaaatttcatcgtagccgacaatgcggaaacggcgggtatcgccctcgtcgttctcaatttccacccaggcgccaaaaaagactttgccttcctgctgcggggagtaatctacgatacgcagattttcgaggcatttagtgagatagcgcacccggcggtcgatctcgcgcagccgtttcttattatactggtagtcggcgttttcactgcggtcgcccagacttgccgcccaggtcacttttttggtgacttcggggcgctcctgacgccagagataatccatttcctgcttgagtttgtcgtaaccctcacgggtaatcaggggcgttttcattttccatgccttattctgtgagcaaatgtacagataacttgctgttaaatatgctttgtaacaatttcgactagaattcataccagaattaactggtggtgggcgcacacttttttagaatacgctttcaagattgtccgaacctttgggagtacaaacaatgcaagagaattataagattctggtcgtcgatgacgatatgcgcctgcgtgcgctgcttgaacgttatctcaccgagcaaggcttccaggttcgcagcgtcgccaacgcagaacagatggatcgcctgttaacccgtgaatccttccacctgatggtgctcgacttaatgttacctggtgaagatggtttgtccatctgccgccgtctgcgtagccagagcaacccgatgccgatcattatggtcacggcgaaaggtgaagaagttgaccgtatcgtgggcctcgaaattggcgctgacgactacattccgaaacccttcaacccgcgcgagctgctggcccgtatccgcgccgtgctgcgtcgtcaggcgaatgagctgccgggcgcgccctctcaggaagaagcggttatcgcctttggtaagtttaagcttaacctcggcacccgcgaaatgttccgcgaagatgagccgatgccgctgaccagcggtgaatttgccgtgctgaaagcgctggtcagtcatccgcgcgagccgctgtcccgcgataagctgatgaacctggcccgtggccgcgaatactccgcgatggagcgttccatcgacgtacagatctcccgcctgcgccgcatggtggaagaggatccggcgcacccgcgctatattcagaccgtctggggtctgggctacgtctttgtgccggacggcgctaaagcatgaggcgaatgcgcttctcgccgcgaagctcgtttgcccgcacgctgttactgatcgtcaccctgctgttcgtcagcctggtgacgacctatctggtggtgctgaacttcgcgatcctgccgagcctccagcagtttaataaggtcctcgcttacgaagtccgtatgctgatgaccgataaactgcaactggaggacggcacgcaactggtggttccccctgcgtttcgccgggagatctaccgcgaactgggcatttcgctctactccaacgaggccgctgaagacgcgggcctgcgttgggcgcaacactacgaattcttaagccatcagatggcgcagcagctgggcggcccgacggaagtgcgcgtcgaggtcaacaaaagctcgcccgtcgtgtggctcaaaacctggctgtcgcccaatatctgggtgcgcgtaccgctcacggaaattcatcagggcgatttctccccgctgttccgctatacgctggctattatgctgatggcgataggcggcgcatggctgtttatccgtatccagaaccggccgctggtggatctggaacatgccgcgcttaaagtggggaaagggcaaattccgcagccgctgcgcgaatatggcgcgtctgaggtgcgctccgtgacccgcgccttcaaccagatggcggcgggcgtaaaacagctggccgatgaccgtacgctgttaatggcgggcgtcagccacgatctgcgtacgccgctgacccgcattcgcctcgccacggaaatgatggccgaagaagacggctatctcgcggaatccatcaataaagacatcgaagagtgcaacgccattatcgagcagtttattgattacctgcgtaccggccaggaaatgccgatggagatcgccgatctcaattcggtactgggcgaagtggtggcggctgaaagcggctatgagcgtgaaatcgaaacggcgatgcacccggatgagatcctggtgcgtatgcatccgctctccattaagcgtgccgtggcgaatatggtggttaacgccgcccgctatggcaacggctggatcaaagtcagcagcggtaccgagccgcatcgcgcctggttccaggtggaggacgacggtccggggatcaaaccggagcagcgtaagcacctgttccagccttttgtgcggggcgacagcgcgcgcagcaccagcggtacaggcttaggcctggcgattgtgcagcgtattgtcgataaccataacggtctgctggagctgggcacgagcgagcggggcgggttatgcatacgcgcctggctgccggttccggtgacgcgtgtcgcaagtcaggtgaaagagagttaagcgcgatgaaacggtaggcccggcaggcaacgcgccgccgggcagctaacaggcaggattacagcttcggcccggcactcaccagcgccgcacccgccggggtatcggtatacttctcgaaattactgataaacagtttcgccagcgcttcggctttctcctgccactgttccggtgacgcataagtattgcgcggatcgaggatcgcggtgtccacgcccggcaacgtcgtcgggatcgccagattaaacatcggcagcgtaaaggtttccgcctgatccagcgaaccattcagaatggcgtcaataatggcgcgcgtatctttaatggagatgcgcttgccggtgccgttccagccggtattcaccagataagcctgcgcgcccgccgcctgcatgcgtttcaccagcacttcggcgtactgcgtcgggtgcagcgacaggaaagccgcgccaaagcaggcggagaaggtcggggtcggctcggtgacgccgcgctcggtgcccgccagcttggcggtgaaacccgacaggaaatggtactgcgtctggttagccgacagccgcgacaccggcggcagcacgccgaaagcatcggcggtgaggaagatcaccttggtggcatgtccggctttggacaccggcttgacgatattatcaatgtgatagatcgggtaagagacgcgggtgttctcggttttggaaccatcgtcataatcgacagagccgtctgcgcgcacggtgacgttttccagcagcgcatcgcggcgaatggcgtgaaaaatatccggctcggcctcttcggacagcttgatcgtcttggcgtagcagccgccttcgaagttaaacacgccgtcatcatcccagccgtgttcgtcatcgccgatcagacggcgtttcggatcggtggagagggtggttttaccggtgccggacagaccaaagaacaccgccacatcgcctttttcaccgacgtttgccgaacagtgcatggaagcgatacccttcagcggcagcaggtagttcatgatcgagaacatcccttttttcatttcgccgccgtaccaggtgccgccgatcagctgaatgcgttcggtcagattaaaggccacgaaattctcggagttcagaccctgctctttccactgtgggttagtgcacttcgcgccgttcatgacgataaagtccggcgtaaagcccgccagctcttcttccgtcgggcggataaacatgtttttgacgaaatgggcctgccaggcgacttcggtaataaagcgcaccgacagacgggtgtcagcgttcgcgccgcaaaaggcatcaacaataaacagccgcttgccggagagttgacgggtaaccaggcctttcagatgctgccaggtttccggggagagcggtttattgtcgttcttgcctttgcctttatcggaccaccacacggtatcgcgggtggtgtcatcgcgaacaatgtatttatccttcggcgaacggccggtgaaaataccggtgtcgacggcgatagcaccagaatttgtcagcacaccgcgctcgtatccttccagatctggattgagctcttcctgatacagcgtgtcgtaatcagggttgtggacaatattcttaacgtcgtggataccataagcctcgagatcctgcggggttaaatcgttaacgcgcatgtcactactccttagctaaatgtactacctgagattgtagggttgttataggggttttaaccgcgacggggctcatagatttacgtatcaggaaaatctcactatatagggttacacccgtcacctggcgagacgaattatggatgttttgctttgagtcagggaggaaacgttacgcaatcgggcttttttagaggattagtcggcggctttgtgagtgtaatcgcattcatgaaaggaaattacgtaactgtttcatgaagatttaaggcgcgccgccgggcggcgacgcgcgagtcaggattaatgcacctgcggatccgcaggggaggcgttattgcggatttccgcaatatccatcgaattgaacagatagtgattaccgcagtaatcgcagtgcatgtcgatttcgccttcttccgccaggatgctgtcgatttcttcatccggcagggtacgcagcgccccggcgcaacgctcgcgggagcaggtgcacttaaacaccacgtcctgcggatcgtagagggtcacttcctcttcgtggtacagacgccacagcacgtcgttggcgggcagcgtggtcagctcttccagcttgatggtatcggtcagcgtcgccagatgttcgaagtcattggcctgggtatcctgcgccggcaggacctgcaacagcataccgcccgccgccgctttaccgtcgaccacgccggtgcgaatgaacagacgcgtcggcagctgctcagaacgcatgaagtaatcttccaggcattcggccagcgtatcgccttccagaccgacaacgccctgatagcgttcgccttcttccggcgcaatggtgatcaccagataaccgttgccgataagggttttcagatcggcattgtcaggcacgtcgccctgcacgcgcgcgacgccgcgcatttcctggcggttgttgccattgatcacggcgaggctcatcgggccatcgccctgcaactgcacggtgatatcaccggcgaatttcagggtggcagtcagtaaacttgtcgcgaccagcaactcaccgaggatcattttcaccggctgcgggtaatcatgattttcaaggatatgttgcaggctcccggataccgtcaccagttcgccgcgaacggcatagttttcaaacaggtagcggtgcaattggtcgtgttgggccatagtcatctcgtcttagggtgaagattactctttttcaccgaatttaaattttatcaggtcgcggcgttctttcttatccggacggcgatcggggtgcggcatggtgagcgcgttaagtttacgggcctcggccattttctcgcgtttttcaacgctttccgccgtttcttcatacaacgccaccgcctcactcgccggacggcgttgttcggtaatggcgctcaccactaccgtgcgttcgtcatttccctgacgcagcgtcagcatggcattcagctcaacaatcttactcggtttggtgcgctgtccgttgtagtgcactttgccgccttcgatcatctcacgtgccagcgcgcgggttttgtaaaagcgtgccgcccagagccatttatcaaggcggacctgctgtgcgggtttctctttcatcgcgtctccttcacgccgagcgcggggatcaaacggcggtagtcattcagccccggatggcgctgatattgcttttcagcgatcccggaatccggattcgtaatgccgaggcagtagcgaataccgaattgtgccgccgcatcaaggatgggttcgctgtcatccacaaacagggtgcgttccggatcaagcccggtctcctgctgtacggcttgccataatcgctgatcctctttcggatagctaaatgtgtgggtggaaagtaataaatcaaggtgtgaacccaggcccgtatgctcaagcttcaccgccaggttatgcgggtgcgcattggtcagtaaaatacggcgtttaccacaggctttcagcgcatccagaaacggcacggtgtcttcacgcaataccgcccgcgcgccctgcgcggtggtcatggcgcaaatatccagcccgaggcgttcactccagtaatccagacagtaccagtttagcgtatgctgcacggcatgatattgctggccgatatacgcctgcgcttcctgcggcgtgatgccccgctgtgcggcataggtttccggcaccagtttttgccagaaatagttatcaaacgccagatcgagcagggtgccgtccatgtccagcaaaacggtatccacgttttgccagtcaatatcaatatgcatagaacactccggacagaaggaaaattcggcgcgggctgcaaccaaagcccgcgccgaatattatcagataatgttgtccggggcggagatcagcgtcgggttgaagcagctgtcatagtactgctgaatgtcggccaggcgggtgcgatggcgctgatagcggcgcagggcctgaatgccgttatacaggctgcaaaggatcagcgccgccagcagcagggtggtcgcggcataacgccacagtccggcgctgtcgggcatacggtgcaggctgatgtggcgggtgccgttggcgtcggtataaatattggtgatgatcccttcggcgctgaacggcgtctgcatcagcatttgcgccagccgctgaaactctccccactgatcctgcgccggatagtcatacagcgcgacaggcggccacggctgatccaccagctcgctgccttcatcgctggcaatcacaaagccgccaggcgccgggctgttcagcgcctgcgctgcacgagcggtttcacgggtaataaagggcgcggtggaggtgtccaccagattatccagcgattcggcgctgaccgggcgcagcagcacgttcacgccgctgagtttaccggtgctggcgcgacgggtcagcgcctcccagtctttggtattgccgaggttaaccagcgcgtttttaagacgcagacactcatcttcggcggcgcacagatcctgggttttcagcacgatatcggcaaaatcatccagcaacaccatgccggatttttctatggccgaacgcagcgcggcgctgacgcgggaatcttcttctgtctggggatgcagctggcggttaaccgcctgaatcagcgcgctggctttattaacggtatcggattccggcagcggcaggggcggcgcatcgttccagataatctgcgagcagtcgaacggtgtaaacggcgacttttgctgggcgttccagttgcctgacgcatggatgctgcacataccggtgccgcgcaggctcagggtatctcccacgcgcaccgccgccttttccagctcgttcacgctggtcgcttcaatggtctgcgcgcctttcatccatgacacggtaaatttgatgggcatatccagcggcacccagaccagcagcatcaccagcacgatcagcgcgcctgccgcgataatggcgctgcgcagccagtgctgaaccgggaaatgcgtggcttcgtcatgcagggataaaaagcgcccctggcgcactacatggcggtcgagataaatatcaatgtccgtctgctggcctaagtcctgcgcgatatagggctgccagtgcggcggataaatcagatcgataatgccgagggaaatattattgatctgctcctgatcgttctcaccaaacagcccccagcgctttggcgtgccgcgcaggcagtggatctcacgtaacgtattttttgccggcggcgcgaataatccccacaggcctgcggccagcagcatgattgccccgcctgccatccacggcacaaaaacgttaggcgtgaccaggcagaagaaaaataacaggaaagaggcgctgatcagcagggcttcccgcagcccgtccgggcggctcagggcatactcttcccgcgtttgctggcgaatattcagcagttctatctgctcgctctcttcgccacgaatggaagcctgagtggaggtttgcacttccagcgagtagccgcgcgtctcctggatgtattcgctcagggtatggccgttgagggaaatgaccagcgggagggtgtcggtgtggatcagttccaccgcgttttcatcggtgatgtactgttcccagaacggcggcaaatgaacttctaccgcatcaaggtagtagcgccatttattgagatcgtcagtgttgatgccgtatcgggtgatcgcgtgcgtcacggaaaaaaccgtgttgctttgcgtatttaacgccatcgccaccggcggcgtggtcgcaccggtcgggccggggacatccaggatacgggatagcgaatcgaggtaactttcaaccgcgctgcgctcatcggcggttaatttacgcgtggcggcatcagcaaaaacctgaagatttggtagccggtagaggcgcttcgtccgtcgcctgaaaaaccaccatgcaagaagtgcgcaggcaaggcaggcagcgaaaaaaatcaaaatggtgctcatactttccccatcttactttttttacagaggtgtggtcagtagcaccctttccaaaaaaaacgtcatcacatggctggtttcgggcaagtataaaactgaattcttttaagcgcataccagcgcgcaggatagtaacaaaacacgcgctgcatgcaatatcagcaaattcctaatctcaattcaagctcttgacttttttaatgaaatgatgaatgtactagttgacgttacaaatatgtaaattgagcgcgaatgccgttgcccaaactgctcgctataccgcacaataaacagagttttcactgtaaagaccccatcataatgagtaaatcattgcaaaaacccaccattcttaacgtcgaaaccgtcgctaaatcacggttatttaacgttgaaagcgtggatctggaattcagcaacggcgagcgtcgtgtttatgagcgcatgcgcccgtcaacgcgcgaagccgtaatgattgtgcccatcgtcgatgaccatctgattttgatccgtgaatatgccgtggggatcgaagcctatgaactgggcttttcgaaagggcttatcgatccgggcgaaagcgtgtatgaagccgcgaaccgcgagttaaaagaggaagtgggttttggcgcgcataacctgacgtttctgaagaaactgagcatggccccgtcctatttctccagcaaaatgaatatcgtggtggcagaagatctctatccggagtcgctgcaaggggatgagcctgaaccgctgccgcaggtgcgctggccgctggcccatctgatggatctgcttgaagatcccgatttcaatgaagcacgcaatgtcagcgcgcttttcctggtgcgggaatggctgaaagggcagggcaggctgtagttttatggccctctcccggcgggagagggctttaggatcagaacagttcgtgcgtctcgccgttatcaataatcgtcgttcccacctcatgtaccgcctgctgtgtcggctgcgtaccttcgatgaaatactcctgacgactgttgccgccgttggccaactgaccggtgctgcggtcgatattgacggttacaatgcccggcggcggcgtcagcggttcttccggtacgccttccagcgcgtgtttcataaaggcatcccaggcaggctgggcgctcttcgcaccgccttcatagcctgagatctgatctttaatcgcccccgaggcggtggtgcgccccagatcccggcgatggtcgtcaaagccgatccataccgaggtgaccgcgccagggccgtagccggagaaccacgcatctttcgagctgttggtggtaccggttttgccgccgatatcattacgtttcagatcgcggcccgcacgccagccggtgccctgccagcccggttcgccaaagatattgctgttcagcgcgcttttgattaagaacgccagcggagtattgatgacgtgcggcgcgtactcctgcgccccggtttgcgccaccagcgcctgattagcctgtcccagctgcggcatcggtacgacggcgttctgctgctcctgcgagcgggcgacgtcttccacgtctttgttctccagcacgccggatttctgcgtttcgccgtaaataaccggaatatcgcaatccgcacaggcgatcttcggacgggcttcaaagagtacgccgccctgatcgttttcgatcttgctgatgaaatacggatccaccaggaagccgccgttcgccatcaccgcataaccgcgcgccacctgaagcggcgtaaaggacgccgatcccagtgccagcgattcggtatgcacgatgttctgcgccgggaagccgaagcgctgcaaatactctgccgcgtaatccacgcccatggcgcgcatcgcacgcaccatcaccacgtttttcgactggcccaggccctgacgcaaacggatcggcccggcgtattccgcaggggagttcttcggctgccagtcagagcctgcgcccgcatcccagcgggaaatcggcacgtcgttgagaatactcgccagcgtcagccctttgtccatcgccgccgtgtagaggaatggcttgatgtttgagcccacctgacgcagcgcctgggtggcgcggttaaatttgctctgattgaaatcgaagccgccgaccagcgctatcaccgcgccgttttgcgggttgatggacaccaacgccgagttgacgtccggcacctgcgccagccaccaggcatcctcaacctgacgcacccagatttgctgtccggcctgcaccacatcggtgactttgcgcggcgtagcgccctgcgcggtatccgaacggtaaggacgcgcccagcgcatgccttccatacgcagcgacactgaggtgccatctgccagcattgccgtcgcttcctgcaggctggtgcccgtgaccacggcaggcaacagcggcccgtaggtcggcagcgcttttaacgtgcgggtgattttctgggtatcccatgcgctttcacccagcttccataacacgttcgacgggccgcgatagccgtggcgcatgtcgtaatccagcacgttgttacgtaccgcctgctgagcggcctgctgcatctgacgcgtgattgtagtgtaaacgcggtagccatcttcataggctttctcgccatagcgggacaccatctcctggcgcaccatctctgacagataaggcgctgagaaggcgatttccggcgcgtgataattggcgtcaatcgcctcgccgcgcgcctgatcgtactccgtctgcgagatatacccttcgctgagcatacgcgacagcaccacatttcgacggctggtcgcacgttccagcgagtagagcgggttgaaggtcgacggcgctttgggcagaccggcgatcacggcgatttcgctcagcgtcagctgatcgactgacttaccgaaataaacctgcgcggcagagcccacgccgtaggcgcggtaaccgaggtaaattttgttgagataaagttcgaggatctcgtctttattcatcagctgttcgatgcggatggcgagaaacacttcctttattttacgcatcagggtgcgttcggggctcaagtagaagtttcgcgccagctgctgcgtgatggtgctcgcgccctgcgaggcatgaccggagaaaagcgccacgcttgccgcacggaaaatccccacgggatcgacaccatgatgctcataaaaacggctgtcttctgtcgcaataaacgctttcaccatcaccggcgggatctggtttaaggtcagcgggatgcgccgtttttcaccgtactgagcgataagctcgccgtcagcgctgtaaacctgcatcgggatttgcaaacgcacatctctgagcgtggcgacatcagggagttgcggctcaacatatttgtataagccatagatcgagcctgctcccagcagaatgcaacagactgcaaggatcaataaatactttacgaacttcaccggagatttcccatttagttttatctgggcagtttataaacaaccgcgcggtagtataaaggcaagcctgatgcattgatagggtcgtcactttggcgaccgataaggagatcgctgatgatggcattcgggcactggcaaataggactgcatattcaacagagtggcgtgtatggcgttgcgctgatccgcgaaaagacgcagtgggcgctacgccgctggtggcaggtgccgctggccgacgatgtcgtcgtcgacgggcaaatccggcagttcgatgtgctttcacagacgctgttgccctggagcaaaacgctgccgcgccgccaccatatccggctcgcttttccggcgggacgtaccctgcaaaagacctttccccgtccggcgatgcgccttggcgaacgcgaacggctgtcgtggatgacgggaagcctcgcgcgggaactggacatggcgggggaagatttacgcttcgactacagtgaagacacgctgcaggacgcctaccgcgtgacggcggcgcaacaaaaagagattgccgacgtgcttgaactggcgcggtcgctgcgtctgcacgttgccgccatcacgcctgatgcctgcgccctgcaacggctgatcccgctgctcgcgccgcctgcccgctggctgatttggcgcgatcccggccagtggctgtgggccacgcgggagcgctggggacgatatccggcgcagggcattgattcgccgcaagcgctggcgcttaagctgggcctggagccagcgctggggcaggtgtgcgaagcggcggcgggctttgatgcctggtgcgctgtggcccatcgccagccgcctttaccggtaaacggcgacgcctgggcgatcgccattggcctggcgctgggtgaggcgcgctgagcatgtacatggtcaatcttctgccctggcgtttacagcgtcagcggcgacgcaatcgcttctggtgcgcggtctataccgctaccgtgctgatcctgctgctggtgacgctggccggacgacagggtatccaggcggagcagcggattaactttcttatagaggacgccgacgccacgctgtttgcggcgctgagccaacgccacgcagagcggacacaggcgcagcagcgctggcagcagcaggcgaaacgcttacagcagcgtgcagcaacgcgggaatggcaacgcagcctgacgcagctggcagaacagatgccggataaggcctggctgacgcagttgcgctatcagcagggaaaacttgcactggcaggcgtcgccgcctcgcttgcggccttatcccggctcgacgatgcgctcggccagatccccggctttcatcccggtactgccggggcgaccacccgcgatgcgcagggccgctggcagtttcagcaccaattaattgaggacgcagcccatgcagcggtgccttgatttctggtacggcttaaccgggcggggccgggtggcgctgtggctgatgctgacgtgtggccttgccgtctgcctgtggtggatagccattcgcccgccggaaaacaggctggcgcaactgaagagcgatcgcgccgcccggcaactgacgttacgccagcattatctgaaaacgtacgcgctgcgcccgccggaggggctgacggaaagcgagcctgcgcgggctttttcgccccttgattttgcgcccccgcacgccaccctgacgcgctggcagcccgccctgcatggcggtgagctggaactggcggcgcagtgggcgcaggcggttgcgacttttgcacgcctggcggagtacgacatggtggtccggggttttacgctggagccggaaggcgggcagttacgcttcactctgcaactggaggcggccaatgatccttaaacgctggatgctggcggcgaccgctttgatctcgcttaccgggatgcgggatccatttttgccgccgccggacctttgtcagacggcgcagctgacccaatggcgctatcagggctatgtcgcgatgcgggggcgcgccatgggcatcctgcgcgatggcagcggcaaatggctgcgggtgagcacgggcgatcgcttaccgaccggatggcaggtgggagagatcacagacctcgagatgcaaatttttaccgcggcagactgcgagccgcagcagtggcgctggacacgacagggagatcagcatgaaacaatggacaggaataatcatgatgtgcagcatcctgaccgcaagggcggaagcgccgaagccggtcacgctgatggtggacgacgtgccggtagtgcaggtgctgcaaagcctggcgcagcaggagaagcataacctggtggtctcgcccgatgtcagcggtacgctctcgctgcatcttattaatgtgccctggaaacaggcgctggaaacagttatcgccagcacgggtctgaccatgcagcggcagggcactattctgcatgtgcattcacaggcctggcagcagcaaaaacaggccagtctggatgccgggcgggaaaagcagcggctgaacctgccgctgcaggaccagagcatcgtactgcgctatgccgatgcgggcgagctggccgctgcgggtgagaagctgctcagcgccagaggcacggtgacggtagacaaacgtaccaatcgccttcttgtgcgtgataatgccgacacgctccgtacctttacccgctgggttgagcaaatggatctgccggtggcgcaggtagagcttgaagcgcacatcgtgactattaatgaaaaaagcctgcgcgaactgggcgtgaaatgggatctggccgaagcgcccgccgatgcggtggcaaaagtcggtcatatgacggccttaagcggcgatctgtcggtggccaacgccaccacgcgggtcggttttaatatcgggcgcatcgacgggcggatgctgggcattgagctgtcggcgctggagcaggagcagaagctcgatatcatcgccagcccgcgtctgctggcgtcccatttgcaacccgccagcatcaaacagggcagcgagatcccctaccaggtgtccagcggcgacagcggcgccacctcggttgaatttaaagaagcggtactcggcatggaagtcacccccacggtgctgccggatgggcgagtgcgtctgaagctgcatatcagccagaacatgcccggacaggtcctgcagcaggcggatggcgaaaccctggctatcgataaacaggaaatcgaaacgcaggtcgaagtcaaaagcggcgacacgctggcgctgggcggcatttttcagcataaaaagaaaaccgcccgcgataaggtccctttacttgccagcgtcccctggctgggacagctgtttcgtcatgacggaaaagataatgaaaggcgggaactggtggtgtttatcaccccccggctggtgccgctgcgttagcgacaggtggccgccatgccgcggaaacgttgcctgcgggtggcaacaatggtgcgtatgatatgcaagaaagttgatggtttttgcactgaactgaactcaggtgtttgacgtgggagatgaattagcttacaaggagtaccgatttgagcgtcagatagtcctgacacacctcaattgacctctgtgaaggattggtgatttattcagttgccaaacaagccggagtattgagataattttcagtctgattctcgaactcaccatatgaggtttcagttcatgtcctgcggcgttgtgtgtctgcgaagcgggtttatcattaacgaatagtcttagtagtaccgaaaaaatggcagagaaacgcaatatctttctggttgggcctatgggtgccggcaaaagcactattgggcgtcagttagctcaacaactcaatatggaattttacgattctgatcaagagattgagaaacgaaccggagctgatgtgggctgggtcttcgatgtagaaggtgaagatggtttccgcgatcgcgaagaaaaagtcatcaatgagctgactgaaaaacagggtattgtgctggcaactggcggcggctctgtgaaatcacgcgaaacccgtaatcgtctctccgcccgtggcgtagtggtttatctggaaaccactatcgaaaagcaattagctcgtactcaacgtgacaaaaaacgcccactgttacaagtggatacaccaccgcgtgaagtactggaagcgctggcgaacgaacgcaatccgctgtacgaagagattgccgacgtcaccattcgcaccgacgaccagagcgctaaagtggtcgcaaaccagattattaatatgctggaaagcaactgatttctggctaaacgtaacccctcgggttttagcaactaaggtggatgtcgcgtcatggagaggataaacgtcactctcggggaacgtagttaccctatcaccatcgcggctggcttgtttaacgatccagcttccttcttgcctctgaagtccggtgatcaggtaatgctggtcactaacgagacactggctccgctgtatctcgataagatccgccgtgttcttgaacaggcgggcgtcaaggtagatagcgttgttctgcctgacggcgagcaatataaaagcctggcagtgctcgacacggtcttcaccgccttgttgcaaaaacctcatggccgcgacacgacgctggtcgccctgggcggcggtgtggtgggcgatctcaccgggtttgcggcagccagctatcagcgcggcgtccgcttcattcaggtgccgaccacgctgctttcgcaggtcgactcctccgttggcggcaaaacggcggtaaaccatcctcttggcaaaaacatgattggcgcgttctaccagcccgcttcggtggtggtggatctcgactgcttatctactttgcctgcgcgtgaactctcctctggtctggctgaagtcattaaatatggcatcattctcgaccgcgaattctttatctggctggaagacaatctggatgcattgctgcgtctggacgggccggcaatggcgtactgtattcgccgctgctgcgagttaaaagccgaagttgtggcggctgacgagcgcgaaaccggcttacgtgctttactgaacctggggcacacctttggtcatgctatcgaagctgaaatgggctacggtaactggctgcatggtgaggcggttgctgcgggtatggtgatggcggcgcgcgtggctgaacgcctcgggcagttcgaccagcaggatacacaacgtattattacgctgctcaagcgtgccggccttccggtcaacggcccgcaagagatgtcccgcgaggcttatctgcctcatatgatgcgtgacaagaaagtgctggcgggcgagatgcgtttagtgctcccgcttgccataggtaaaagtgaagttcgcggcggcgttccgcatgatgttgtacttgacgccattgcggattgccagcaagcgtaacaattagaaaggtctggccgcgccagccgtggcgttttaacttcgggcgatatgcacgtggtaagcataagcctatgagtggggtgttaaatggatgaatacaaaccagaagacgagctgaaacccgatcccagcgatcgtcgtactggtcgttcccgtcaatcttctgatcgtgacagtgaaccgcaaatcaattttgatgatgtcgatctggaagcagacgaccgtcggccttcgcgatcccgtaaaccccgtgaagacgaggagtacgaggagtatccggaagaagacgcgtctgtggatgagccgcgcgaagtgcgccgtccgcgcaatcgtaaaaaagccgccgccgcgaaacccgcttctcgtcagtacatgatgattggcctggggatcctggtgctgttgctgctaatcgtcggtatcggctccgcgctgaaatcgccggtgagcaaaaacaatggcgagcaaacggcgtccactgagaaaaatatcgatctggctggcagcagtactaccaacaatgccgccgaccaggctaacgccacgcagcctgcgccaggcgccacctctgcggagcagacggctggcaaccagcaggacgtttccctgccgccgatttcttcgaccccgacgcaggcgcaaactgccgctacgccggaaggccagcagcgtgtggaagtgcagggcgacctgaacaatgcgctgacccagccgcaaaatcaggatcagctcaataacgtggcggttaactccacgctgccgacggaaccggcgaccgtggctccgctgcgtaacggcgctgccgcaccgcgtcagaccaccgacacggcggaacgtcagacgaccccgcgcaccaccgagcgcaagcaggcggtgatcgagccgaaatcgcaaagcaaaccgcagagtaaaccgcaggctacgcagaccgcgccaaaagccgtgccggttcagccgaagcgtacggaaacggtgattgccgcaccggcgaaaacgccggcaaccaacacggcaccgaaagcgaccgccagcgtaccggctaaacctgccgcgcctgcggcgacagccaccaccacggccccggcagcgaccacgccagcgaaatccgcagcgccagccgccaccgcgggtggtaccacgggtaatgtgggcgcgttaaaatccgcgccgtcaggacactacacgttgcagttgagcagttcttccaactccaacaacctgaacgcctgggcgaaaaaagagaatctgaaaaactacgtggtttatcagacctcccgcaacggtcagccgtggtatgtgctggtgagcggtgtgtatgcctctaaagaagaagccaaacgcgccgtggcaacgctgccagccgatgtgcaggcgaaaaacccatgggcgaagccagtgcaccaggtgcaggccgatctcaaataatgattaaagcgcaggttgctgtcggagctttctccacagccggagaaggtgtaattagtcagtcagcatgaaaaagaatcgcgcttttctgaaatgggcagggggcaagtaccccctgctcgacgatatcaaaaagcacttgccggaaggcgagtgcctgattgagccgtttgtaggtgccgggtcggtatttcttaataccgacttttctcgttatatccttgccgacattaacagcgatctgattaacctctacgacatcgtgaagacccgtaccgatgagtatgtgcagagcgcgcgtgaactctttgttccgcaaaccaatcaggctgaggtgtattaccagctgcgcgctgagtttaaccagtgccacgatacgcttcgtcgcgcagtcctgttcctgtatctgaatcgtcatggctacaatggtctgtgccgctacaatttacgcggcgagttcaatgtgccttttggtcgctacaagaagccctacttcccggaagcagagctgtaccatttcgccgagaaagcgcagaacgcgtttttctactgtgaaacctatgccgacagcatggcgcgcgccaccaaagattcggtggtgtactgcgatccgccttacgcgccgctgacctccaccgcgaattttaccgcttatcacactaacagcttcagcctggaacagcaggcgcatctggcgcagttggcggaaaatctgaagaaagagcagatcacggtgctgatctctaatcacgatacgtcgttaacccgtgaatggtacagtcaggcggagatgcatttgttaaaagtgcggcgcagcataagcagtaatggcggcacacgtaaaaaggtggacgaactgctggctctgtatcgcccatgagccgtttcgcccgccgctaaaacctctaaggagatgcggatgaaacagtatttaatagccccttcgattctgtcggctgattttgcccgcctgggtgaagataccgcgaaagcgctggctgccggtggtgatgtggtgcattttgacgtgatggataaccattatgtgccgaacctgaccatgggtccgatggtgctgaaatccctgcgcaattacggcattaccgccccgattgacgtgcatctgatggtaaaaccggtcgacagactggtgccggattttgccgcggcgggcgccagcataatcacctttcatcctgaagcgtccgagcacgtggaccgcacgctgcaactgatcaaagaacacggctgtaaagccgggctggtgttgaatccggccacctccctgaactacctcgattatgtgatggacaagctggacgtgatcctgctgatgtccgtcaaccccggctttggcggtcagtcatttattccgcacacgctggataagctgcgcgaagtgcgtcgccgcattgacgcttccggccgggatattcgtctggaagtggacggcggcgtgaaggcgagcaatatccgcgatatcgccgctgccggtgctgacatgtttgtggcaggctcagccatttttgacaagccagactataagcaggtgattgatgaaatgcgcagtgaactcgcaaaggtcggtcatgaataagatgcaggatattcgtggcgtggcattcgatctcgacggcacgctggttgacagcgcgccgggcttaacccatgcggtggacatggcgctctacgcgctggaactgccgcaggcgggggaagagcgtgtgatcacctggattggcaacggcgctgatgtgctgatgcagcgggcgctgaactgggcccgtcaggagcgcgcggctttacgctcatcaatgggtaaacctgccgttgaccaggccgatattccggaagaagagcaggtgcgcatgctgcgtaaactgttcgatcgttattatgccgacgtggtggaagagggcagtttcctgttccctggcgttgaacagacgctggccgccctacaggcgcagggcctgccgctggcgctggtcactaacaaaccgacgccatttgtcgcgccgctgctggaggcgcttaatattgcccgtttcttcagcgtggtcatcggcggcgatgacgtgaaaaacaaaaaaccgcacccggagccgcttctgctggtggcggaaaagctgggcatcgaaccgcaggcgttgctctttgtcggcgattcccgcaatgatattctggcggcacgtgccgcaggctgttgctctgttggcctgacttacggctacaactacggtgaagccattacgcttagcgagccggatcacgtgttcgaccgctttaacgatttactgcccgtgctcgggctcccgcacagcgaggatcaggaagaaaatcatgactaagcccatcgtatttagtggcgcacagccttcaggtgaactgaccatcggtaactatatgggtgcgctgcgtcagtgggtaggtatgcaggatgattaccactgcatttactgcatcgttgacctgcatgccatcaccgcccgccaggatcctgaaaagctgcgtaaagctacgctcgatactctggcgctctatctggcgtgcggcatcgatccggaaaaaagcaccatcttcgtacagtcccacgtgccggagcacgcgcagctgggctgggcgctgaactgctacacctattttggcgagctgagccgcatgacccagttcaaagataaatcagcgcgctattccgaaaacatcaacgccggtctgtttgattacccggtgctgatggccgccgatattctgctctatcagaccaaccaggtgccggtgggtgaagatcagaagcagcaccttgagctgagccgcgatattgcgcagcgcttcaacgccatctacggcgacgtctttaaagtgccggaaccttttattccgaaatccggcgcgcgcgtgatgtccctgcttgagccgacgaaaaaaatgtccaagtccgatgataaccgcaacaacgttatcggcctgctggaagatccgaagtcggtcgtgaagaaaatcaaacgtgcggtaaccgactccgacgaaccggcagtcgtgcgctatgacgtgcagaacaaagcgggcgtttctaacctgctggacattctctctgccgtgaccggtaagagcatcccggaactggagcagcatttcgaaggcaaaatgtatggccacctgaagggcgaagtggcggacgcggtatccgctatgctgactgagctacaggaacgctatcaccgctaccgcaatgacgaagccttcctgcaaaaaatcatgcgcgaaggggcggagaaagccagcgcccatgccgccgtgacgctgaaaaaagtgtacgaagccattggttttgtcgcgaagccgtaacgcattcgttcagaaaaaaaccgggaaattcccggtttttttgtatcggtgcaagagtgattcagacccttactgtgctgccgccgggccgcagccgccgatgattttagaaacagaaatggccggatgcagcaggtagtcgtagctgcaattgttggctttgttctgcacgtgacctgtacaggcggagagggtagtaacagctgcaatcagcgcagtgattttaataatcttcttcattcgatcttccttgttattcatagtcatcagcatgtttttcataattgacgtggataattgcagagcgcaatatttccacggtcaattttaactgcatgattatattgaattttaaggggatctcttagtccggagccggactggtaacgtggacagaaaaatgaataaagccagacggcgctggctttatctgaagatatcaatgatttgagaaccagttaagcttatcgcgcagggcgaccacgcgaccgacaataatcagcgccgggcttgctacctgggttgccagttcccccagttcattgagcgaaccgctaaccactcgctgcttaaccgaagtaccgttttccaccagcgccaccggcatatcgctttccatgccgtgggcgatcagctgcgcctggatagtcgcggcctgattcagccccatgtaaaacaccagcgtctgtttttcggcggcaaggttggcccagtccagttccccgccggttttcagatggccggtgatcaaccgcacgctctgggcataatcacggtgggtcagcggaatgccagaataggctgaacatccggatgccgccgtgatccccggaactaccgagaagggaatgcccgcatgacacagggtttccagctcttcgccgccacgtccgaagataaagggatcgccgcctttcagacgcacgacgcgtttaccggactgcgcggcgcgcagcaggatttggttaatctcttcctgcggcacgcagtggtaaccggcgcgtttaccgacgaaaatgcggtcggcgtcgcggcgcaccagattcataatgtcgtcggagaccaggcggtcgtacaccactacatccgcctgctggatctgctgcaggccttttaaggtcagcagcccggcatcgcccggccctgcgcccaccagcaccacttcgccgcgtttatccagcggctcgttcagcagctgttcggtgacgtcgctgatggcctgagtatcgtcgttggcgagcgactgggcgaggcgatcgttgacaaagaatttttcccagaaacggcggcgctcgcccacgttatcaaagtgggttttcacgcgatcgcgcagtttacccgcgtagcccgcaagctgcccgagatgctgcggcagcacggcttcgagtttttcacgcagcagacgggccagcacgggggaggtgccgcccgaggagaccgccaccatcagcggcgaacggtcaataatggacggcatgataaaactggcttctttcggcgcatccaccacgttgcagaaaatacgccgcgcttcggcggcatcgctgacgcgctgattgacgtcgttatcgtcggtggcggcaatcaccagccaggtggtgtcgagcagcgcttcattaaaatcgccctgcgccagcgttaacatgccttcgtttgcccagacggtaaactgcggcgaaaaggccagcgcattaacggtgagccgcgcaccggcttccatcaacagtcgggctttacgttctgcgacatcgccaccgccgaccagcaggcagtcacgaccgcgtaattgacaaaagatgggaagatggtgcacgacattacctcattatttttattggcccagggtttccgtgagcgtcgctttcgccggtaccgggcgttcagcacgaggagtagcataccaataacccagtcccataaatacggcaccagataaagtattgcccagggttacccacaagaggttatgaccaattccggagagggtataggcttcgctgtgatgcccaaaccaggaaagggcgaacagcgtcatattggcaacggagtgctcgtaaccggaggcgataaacgccagcaggcaccaccagatagcgaggaattttgccgcgccttctgtgcgtaccgccatccagatcgccagacaaaccagccagttacacagtgcgcctttaaagaacagtacgcctgcgggcgcggtggttttcgccagcgccgcggtatgaaccagactggtatccagcggtaacaggctgccgccgccccagttatagagcagcgcgacgaacaccgagccaatcaggttgccgagccaggtttgcggcagaatagtccacatctgaccgtggctgatggtgcctgctttgacgccgaaggtcagaaacatggtgtgaccggtgaataattcagaaccggcaataatcaccagcgttaacgcaatcccgaaggtcgcgcccatcaccagcggacgaacgctggggtcaagcagattaccgagggtaaagatgaggataatacccagccccacgtaagcgcccgccatagcggagctgatccagaagccgagcggattttgcgccgagagccgggcaattcgcgccgcgttcgcggcacatttattgatagtgtcggtaaacatgttgattatcctttaacacgtcatcctttgggatgccgcaaaaatgatgttgtgtgaaaaattaaaaagaaaataaaaatttaaaaaaggggaggcgttgcgcctccctgaatgcttaacagcgtacctgcacttcgccatccttcacccgcgcgtcaaaatgcgcgaccgagtggctttcatcctccatgcacagcccgtcccgcagacggaaacgctgttttttcagcgggctggcgacccacagctcgccgttgtgctcggcaatcaggccgcgcgacagcacgctcgcttcaaaaaacgggtcgatattgctgatggcaaaaacttcctcgtcctgacgcgggcgaaaaatcgccacctgctgatcgttcaccagcgcgcaaacgccggtctgcggaatgatgtcagcgatgttgcagatagtgttccactggctcatacggtttcctccaccatggtcaccgggatacgctcataaggcgtggccgggcgatgctgttgacgttccgggacgatctgcacgttcggatcgcgctgcgggctgttaatgaagtgtttgaagcgcacctgcgcctgcggatcgttgacggtttcggtccactcgcagaccaccgcctcgcgcagacgggtcatttcggcttccagctgcgcgttcaggcccagcttgtcgtcaatgatcacgctcttcaggtaatcaatgccgccttccatattttccagccatggcgcggtacgggtcagcttgtcggcggtgcggatgtagaacatcatgaagcggtcgaggtatttcaccagcgtatcgcgatcaagatccgccgccagcaggtcggcgtggcgtggtttcataccgccgttaccgcagacgtacaggttccagcctttatcggtggcgatgatgcccacgtctttaccctgcgcttccgcacattcacgggtacagccggacacgccaaacttcattttgtgcggggtgcggatgcctttgtagcggttttccagctcgacgccgaagcccacgctgtcgcccacgccgtaacggcaccaggtggagccgacgcaggttttcgccatacgcagcgctttggcataggcatgaccggtttcgaagcccgcctcgataagctgacgccagatttccggcaggtcatctttctgcgccccgaacaggccgatacgctgagagccggtgattttggtgtacaggttaaattcgcgggcgatacggccgacttccatcagcccttccggggtgatttcgccgccagcagagcgcgggatcaccgagtaggtgccgtctttctggatattcgccaggaagttgtcgttggtatcctgcaaaggcgtgtgctgcggtttcaatacgtactcattccagcaggaggccagcagcgagccgacggtcggtttacagacttcacagccgtagcctttaccgtatttgtgcagcagttcgtcgaaggttttgatgccttccacgcggatcaggtggtacagctcctgacgggaaaacgcaaagtgttcgcacaggttatggttaacttcaataccctgtttcgccagctcagcgttcagcacctgggtgaccagcgggatacaaccgccgcagccggtaccggctttggtttccgctttcagcgccgccacggtatggcagcctttgttgatggcggaaatcagcatgcctttggtgacgtcgaagcaggagcagatttgcgcgctgtccggcagtttatccacgccgattgacggtttgccgctgcctgcgtgggcgggcaggatcagcgcgtccgggttttccggcagttcaatggcgttcagcaccagttgttgcaggttgccgaagtcgctggtgtcgcccaccagcaccgcgccgagcagggttttattgtccgggctgacgatcaggcgtttatagacttctttgctttcgtcgaggtacacgtagctgcgcgcgcccggcgtacggccatgcgcatcgccgataccgcctacgtccacgccgagcagtttcagcttggcgctgaggtcggcgccttcaaaggcgttggtgttgccgaggatatggtcaacggcaacctgcgccattttgtagcccggcgcgaccagaccgtatacgcggttattccagctggcgcattcgccgatggcgtagatgtccgggtcggaagtctggcaggtgtcgttaatcacgataccgccgcgtgccgcgactgccaggccgcactgggtagccagtttgtcgcgcgggcgaataccggtggagaagacgataaagtcgatttccagatcgctgccgtcggcgaagcgcatggttttgcggccttcaacgccttcctgcacgatctcctgggtgtttttgctggtgtgcacgcgcacgcccatgctttcaattttacggcgcagctgttcgccgcccatctgatcaagctgttccgccatcagcattggcgcgaactcgataacatgcgtttcaacgccgaggtttttcagcgcgcctgcggcttccagaccgagcagaccgccgccgaccaccgcgccgcgacggctgcgacgggcgcaggcttcgatggcgttcagatcttcaatggtgcggtaaacaaaacagtcctgcgtgtcagaacctttgatgggcgggatccacgggtaggagccggtcgccatgatcagtttatcgtaatagaccgtgcggcctgcgctggagtggatcactttttcctggcggttaatggtgatagcgcgctcgccgaccagcaccttaacgccgtgcttctcgtaaaatccttcccgcaccagcgacagctcttcagcggtatggtgagagaagtaggaagacaggtgaacgcgatcgtaggctttacggggttcttcacaaaaaatggtaatgtcgaactggctggcatccgctttatcgagaagatcctcaacaaagcggtggccgaccatgccgttaccgattatagcgagtttgactttgctcatttttgcctcgatttcttttctattactgcctaccttaacgattcagcaatggcgtttattgatgcaaatcaattacacctttaactactccttaatgagtagatgactgatttcaggggatttttctaagttgaggaaatgtcaggcttttcagagttgaggaaaatctgagcaaaaaacagggtttttaagaaaacgacctactccttaagatcaggaggtcatttacagggatggagtagtgtttttatgcggggaagtacagcaaaaaatgccccttcccggcaggaaaggggcgcagagattagtgtgcagttgccgttgcgccatgctggcgatgacgggtaacgaagcccagcgcaaagcacatcacgaagactaccgcgtacagcccgttggcggtgaacagtgccgcctgcgggccgctactggcaacaatcgggccggtgacgatgaaggtcagcatggtgccgatggtgccgcaggtcagaataaagttaaccagcttcggcgacgccactttcgtctgttgcgagccgagcgtgatgatggtggtgtagatcgcgctggagaagaagcccagtgccatgataaaccacgccatatggtcggtagcgctggtgatgaacaggtacatcagtaccgccgccaggcctgccagaatggtcagaatgcgctgcagatcgaagaagcgcaggatgaagctgaacgcccacatgccgaccatgtacgacatccagaaatcactcaccagtttgccctgagcgctgacgtccatgcccatgcctttcacgtattccggaacccaggcgataaagcccagctgacccaggatgtagcacatggccgcgatggacaggaacagcacgccgatgccccatttttctttcactaccggcttgtcgcccggtgccgcatgtttgcccagcgccgggaattcacaaccaatggtcagaataaagatagcgacgtacaccaggccgatacaggcgtaaacccagtaccattcgatgctgcgcgccagcaggtaagcggcgaccatcgggaaaatcatcccggccatgctgaagaaggagtcggtgaacagcaggcgcgaaccacgctggcggccttcatacatctgcgtgaccaggaaagtaccaatcgacatggtgatgccgctgaccagaccgagcacgaacatggcggcggagaacagcgccaggctgtgggtcagcatcagtccggcaacggccagaatcatcagcacaaaaccaaagcgcagctgcgttttcagcggcacgatttccatcagccaggcgttcaggaagatagagattaagatcccggcgttcaggaaggtgaaggtgttactcatactggataccggcagattaaagtattctgcgatatttcccatcaccattccggtgacgatcaccaacgcgccggtaagggcgtaggagaagaagctgatccatgtgagcttgatacggttgctgttagtcatgtctggcctgtgcatataagtgtaaagcgcgttgacagcgctgtgaacgggcagattttatgcaataaagtgatacatttaaatctttaataatgaatatgaaacttattgcagtatttattatgagatcgctcacactttaggccgctatttatcataaatttgtgaggttacaactgtttcaatttcgtaaaattaggtaaaaggctggcctgtgagctatcgcctctttagaatctatccactcgctcttttaccgctctatgtttaggaattctcatggttaaaatgactctggcggctgtcgcagctgtatttgctctttctgcaatttcccccgctgcgctggcagcaaaaggtgatccccatgttctgttgaccacgtctgccggtaacatcgaactggagctgaacagccagaaagccccggtgtccgtgcaaaacttcctcgactatgtgaacagtggtttttataacaacaccaccttccaccgcgtgatcccgggctttatggtgcagggcggcggtttcaacgagcagatgcagcagaaacagcccaatccgccgatcaaaaacgaagcggataacggcctgcgtaatacccgcggcactatctcaatggcgcgcaccgcggataaagacagcgcgaccagccagtttttcttaaacgtagcggataacgccttcctcgatcacggtcagcgcgatttcggctatgcggtattcggtaaagttgtgaaaggtatggatgtggcggacaagatttctcaggtgcagacgcacgatgtcggcccttaccagaatgtgccaaccaaacctgttgtgatcctttccgcgaaagtcctgccgtaacattttgcacgggttttgcggcccgtgctcctcttcgctcccctgcgcaacgccggattgccgcttatacttgtggctcatgggcgacaacaacagggaggcgtcatggctaaaaaactcaccgaccggcaaaaatcccgtctctgggaacagcagcgtaacgtcaatttccaggccagcagacggcttgaaggcgtcgagtgtgaagagatcaaactgagcgccgacgaagcgaacgtgcgcattgaagcgttaagggggaaccatgagcgataagtttggcgacgggcgcgatccctatctttaccccggcctcaatgtgatgcgcaataagctcggcattcgtcagacacagcgtctggaagaagcggcgtatcagtttaccgcgctgcgcgccgccaccctgccgttaggcacggatacccccggcctgccgcacctgtgcgccattcaccgccatctgtatcaggatatttttgactgggcgggcgatattcgcgaagtggacatctatcagggcgacacgcgtttctgccatttcgattacatcgaaaaagagggcaacgccctgatgcaggagctggaagtggaaaactggttgcagggtcttgagaaagacgctttcaccgaacgccttgcgcactattattgcgaaatcaacgtgctgcacccgttccgcatcggcaacggtattgcccagcgtattttcttcgagcagttggcgatccacgccggttacatgctggactggcgcggcatcaagccggatgcctggagccaggcgaatcagagcggcgcaatgggcgatctctctgcactgaccaaaatctttagcaaggtggtcagtgaagcgaaagaggcagagtaagccaacgcccggcggatcggtattttttgcaggcccggcaagcctgcgccgccgggcaataaaacaggtacactacccccatcgcattttttgactgaaagatcccgcaccatgatcctgcttatcgacaactacgactcttttacctggaacctctaccagtacttttgcgagctgggcgcgcaggtggaagtcaggcgcaatgacgttattagccttgccgatatcgacagcctgtcaccggacaaaatcgtgatctcccccggtccctgtacgccggacgaatctggcgtgtcgctggaggtgatccgccattacgccggcaagctgccggtgctgggcgtgtgtctgggacatcaggcgattgcgcaggtgtttggcgcgcgcattgtgcgggcgcaaaaagtgatgcacggcaaaacctcgccggtcacccatacggggaagggcgtgtttcaggggctgaataatccgttaaccgttacccgctatcattcgctggtgatcgaacccgcctcgctgcccgactgctttgacgtcaccgcctggagcgatacgcaggaaataatgggcatccgccaccgggagtgggatctggaaggcgtgcagtttcatccggaaagcatcctcagcgaacaggggcatgaactgctggctaatttcctgtcgcgatgattttttgttgccttgttgtgattttttatgcatattttgtgcttatattttcataattaatacagcacaaaacggatgggcgtgacatggcaactgaacaaaacgcaattacgcgcgcaacatttgacgaagtaattctgccgatttatgcacctgctgaattcattccggtaaaagggaagggcagccgcgtgtgggatcagcagggtaaagagtacgttgattttgcgggcggtattgccgttacggcgctcggtcattgccatccggcgctggttgaggcgttaaaaacccagggggaaaccctgtggcacaccagcaacgtctttaccaacgaaccggccctgcgcctgggccgtaaaatgattgaggccacctttgccgagcgcgtgctctttatgaactccggcaccgaagctaatgaaacggccttcaaactggcgcgctactacgcctccacccgtcacagcccctataaaacgaaaatcatcgccttccacaatgctttccatggacggtcgctgtttaccgtgtcggtgggcggacagccgaaatattccgatggcttcgggccgaaaccggcggacatcatccatgtgccctttaacgatctgcacgcggtcaaagcggtgatggacgatcacacctgcgcggtcgtcgtggagccgatccagggcgagggcggcgttacggcggcgactccggaatttctgcaagggctgcgcgagctgtgcgatgaacatcaggcgctgctggtatttgatgaagtgcagtgcggcatgggccgcagcggtgaactctttgcctatatgcactacggcgtgacgccggatattctcaccagcgccaaagcgctgggcggcggcttcccggtcagcgccatgctgaccacccaggagatcgccagcgcgtttcatgttggctcccatggatccacctacggcggcaacccgctggcctgcgcggtagcgggcgcggccttcgatattatcaatacgccggaagtgttgcagggggtgaacgaaaaacgccagcgctttgttaaacatcttcaacagatcgatgagcagtatgacctgttcagcgatattcgcggtatgggtctgctgattggcgcagaactgaagccgcaataccgtggtcgcgcccgtgatttcctgtatgcggccgccagcgaaggggtgatggtgctgaacgccgggccggacgtgatgcgttttgcgccgtcgctggtggtggaagagagcgacatcgacgagggcatggcacgttttgcgcaggccgtcgcgaaaatcgtccacggttaaccctgttgcccggcggcgctgtgcttgcagacttaggctcgtaggccgggtaagcgaaagcgccacccggcaaatttctaatgcttccgctttcctgtccgcatcagccagatgccgtgatgcgggcgctgacgccatgccaccgacgaaatggtgtgcatggtgttcagatgcccgataacacgttgcagatgctgttccagcgtgctcatcgggccctgggttaaggtctccggcgcttccagaatattggcatcccccgaccctgccggcccgtcatattccaggcgctgctggcaacgctgaagcgcaatttcacaggattccagataacgttgcgccagatccggcgtcagcatggtgtgctcgcgcgccagggtggtcatcgcgttaatgtgctcgacgataaactggctgtgcgtcacccagagtttcatatcttccaggtaatgagtgttaaagcccggctcctgcattgcctgattgagcgagttaaacagcgtattgtgtgcctgattgacgcgcatgcgctggtacgccagcggcgtgggctgcggatcgtcgctgaggatcaggcggatggcctcctggtccgcctccagcgcgtcgtgggcgttctgccgcaacagcccgctctgccactgcggccacagccagaccatgccgccaaaggcgatcagacagccaatcagcgtatcgataagcctggcgacgataaactggtcgccgctcagcgtcagcagctgtaacgaatacaccgcggtgatggtgaagcccaccgtcgcccagccataattcttgcggatgatcagatagctaatcagcgtcaccaccagcataccgagcagcgtatagccttccggcacgtgaaagtgcagcgtgataccggcaataatcagccccgccatagtccccgccgcccggtgctgaatacgcacccgcgttgcgccgtagccgttttgcgtcaccagcagtaccgtcatcaggatccagtagggcttgggcagatgcagcgcgatccccatcaggctggcgatggcgagcatcacggcaatgcgcgccgcattgcgcagcgccggggatttaaacgacagatagcttttgagcgccgggatcagcggctggcggcgctgtttatcctccatcagatcgcgcacatacagcgggcgctgggtgcgcagtactctggcgatacggctgaagtgccaggcgcagaactggccgaccgggttatccggatgctgacgggcgattttttccagcgcgccgacctgcttatccatattaaagcgcacaggaaaacggtgatagagaatgtcgtccgccagcacccgcagccgggcggcgaccacctgcgcgttccagcggatcaccgcttcggcgtgactctgctccaccagtttttgcacttcctggggctgatgcaggctgacggaaatatgctcctgcaggtccagcgccacctgaaacgcccgcagcaggcgcttgtaatcgttatgctgattagcggcgagcatgtgcatttgctggtaacactggctgatcagatccacggctttctgctgacgcgccagcagcggcggcagggctttttccggatccgcatgctgggtcagcagactgtatttagcttcgcagtactccgccagctggcggtagagcaggcttaaggattcgcgcagcggctgttcgcgccacatccagaaccacagccagttaaacagcccgtaccacagcgtgccggaggcataaatcagcagcggctcccataccggcatatttccggcaaggcttaaggtaaagatggcggcgataagcgacgccggcagcaggcgcgcgtgcagggcgctgatctctgccgtgacgccaagcagcagcgccagcccgccgaggatcagcggcagggcgatgttctccgccagcaatagctgcaccgccaggctacagcccgcaaacagcgagccgcccacgatcaggcgtttgaaaaagcgtttatggggggtatcgagcccggcaatgttgcagcaggcaggaacgagagagaacagcagcccctgttgcaggtgcccgaaggcgaggccgatggccacagggagacacaacaccagcgtttgtcgcagggcgtagttaatttccgggtgatagatcagcctgcgccacatgagaatgcaaacaaaaacggcgtctcgcagatgcaatacgccgtttgaggggcttagcgggttccgtaaaccacgatggttttaccgtgcgcagagatcaggttttgatcttccagcatcttcagaatgcgaccgacggtttcacgggagcagccaacgatctgaccgatctcctgacgggtaattttaatttgcataccgtccgggtgggtcatggcgtccggctgtttggccaggttcagcagcgtctgcgcgatgcggccagtcacgtcgaggaaggcgaggttacccactttctcggacgtcacctgcaggcggcgcgccatctgggaagacaggcgcatcagaatatccgggttcacctggataagctgacggaattttttgtacgagatttctgccacttcacaagcggttttagcacgtacccaggcactgcgctcctgaccttcttcaaacaggcccagttcaccgataaaatctccctggttgaggtaagagaggatcatctctttaccttcttcatccttgatgagcactgccactgagcctttaacgatgtaatacaacgtttccgctttttcaccctggtgaatcagcgtgctcttcgacgggtacttatgaatatggcaatgagacaagaaccattcgagagtcgggtctgtttgcggtttgccaagcaccatgcgcggttatcctctgttataagctggctccagagccaggatgaacactctgcctctggggttgcaatcatatgcttccctgttcccgggaagtggccgttcgaaaatccagcctttaatgtttgatgtcgtctgcatacatgtgcaacgtcaatgtatcactgtagcagccagaatgttttagcatagcttttgctgtgtgtctcctggtgtctcgcttcagcatgatgcaggtcgccttccgttgcgagaattgttatgtgcgcgtaatctgaagggaaatttaccgcgccggagcgaataaaatgcaagcaagagtcaaatgggtagaaggtttaacgttcctgggcgagtctgcttcaggccaccagatcctgatggacggcaactcaggcgataaagcgccaagcccgatggagatggtgttgatggccgccgggggatgcagcgccattgacgtggtatccattctgcaaaaagggcgtcacgatgtgacggattgcgaagtcaaactgacctccgagcgccgtgaagaggcgccgcgtctgttcacgcacatcaatctgcactttatcgtcaccggcaaagcgctgaaagaagcggcggtagcccgcgcggtggatctgtcggcagagaagtattgttcggtggcgctgatgctggaaaaagccgccactatcacccattcgtttgaggtgattgaggggtgatttttggtgcacgtcaggtggcgctgcgctaaccctgccggatggcgctacgcttatccggcctacaaaagcttaatctgtaggccggataaggcgttcacgccgccatccggcacaaaaaatcactcgattttcttgccttccatcagccgctgcaccagcggcagcatgatcagctccatcgccagccccatttttccgcccggcaccactaatgtattgatgtgggaaatgaatgagccctgcaacatcgccagcagccagggaaaatcgatgccttccagattacggaaatggatcaccacaaagctttcgtccagcgacgggatcgctttcgcggcgaaggggttggaagtatccacggtcggcacgcgctggaagttaatgtgcgtgcgggaaaactgcggcgtaataaagttgatgtagtcttccatcgaccgcaccaccgaatccatcaccgtttcccgtgaatgcccgcgctcgctggtatcgcgcaccagcttctggatccactccaggttaatgatcggcaccacgccgaccagcagatccacatggcgcgacacgtcctgctgtggcgtcaccacgccgccgtgcagcccttcataaaacagcacgtcggtaggttcaggcaacggttgccacggtgtgaaggtgcccggcacctgattccacggcactgcctcatcgtaggtatggagatatttacgtgactggccggtgccggtcagcccgtactcgataaacgtctgctccagcagcccgaagtcatttgcttccgggccgaaatagctgatatgccgtccggcatcgcgcgctttacggatcgccatgtccatttccgggcgcgtgtaacggtgaaagctgtcgccttccacttctgcggcgcgcagatccagttgcgcgaaaatcttacgaaacgcgaggctggtggtggtggttccggctccgctggaacccgttacggcaatcaccggatgtttggcagacatagcaacgctccctaaaactggttttattcgcgaaactgcttcttcggcatgatgttcaccgtttcatgcagttcagaccacaccagcaccgcttctccggtttgcagctggcgcttaacgtcggcgaccttttgttcaagtgaacgctcatgttcaccataatcggtgccttcacgcaagacaaagctctcgatcaggctgtcgagcgtctctgttgccagatcctgccaggggataatcatttacgcctccagatatgttgtcagccagtcgggaatgcgcttttccagccacatttccgggcggcgcagcgtcccgcccacaaagcccacgtgcccgccgtgttccgtcaactgatactccacgttgggcggtaaataacccgccgccggaataacattatgatccataaacggatcgtctttggcatgaatgataagcgtcggcttgcgaatcttcggcaacaccggcatggcgctgcactgacgataatagtcgatggcgtcggtaaagccgtggatacgggcggtgatcagatcgtcaaaatcccggatgcggcgcatacgacgcaggcgggtaagatcaaccggcagtgaatccggatacgccttcagcttgcgcatcgcgttgccctttaacaggttcagcaaatagtgctgataaaagcgcgaaaagcctttatccatatgatagctacaggcttccagcaccagcggagccgatacgatcaccgcagcattgagcggcagatcgggttcatttttgcccagcagacagccgagcatattaccgccgagggaaaaacccaccgctgccgtgggcgctgcgccaaactcacgctgtaaccagtgtaaaaaccaggtgccgtcttccgtttccccggagtggtaaatgcgcttcagacgattgggttcgccactacagccgcgaaagtgcatcaccacgccgagccagccgcgcgcgcgggcggcgttgatcaaaccgtgggcgtacgggctgtgcaggctgccttccagaccgtgaaacaccaccagcctgggcttatgtttggccacatgcggatcttcgctccaggcgagatcgacaaaatcgccatccggcagctcaaggcgctgccactggggcgtgaactggagccgacggcgaatgaggcgcggcagcatggtttgcaggtggggattggctgcgccggccagtgggcgaaatgcaaggctgtcagcggcagtatccgggatctctaagggcgttatttgagccataatcgtgcgatgtgttcttaaaagtctgccgactactatacctgttaaaccccgctgctgcggatgaaattgcgtttccggccctgatgcgttgcctgccatagatactttttgcgttgcttttcctgatctccatcacagattgtcactttgattattactctcaggctaatgattaagcacagggcttaattgatgactttctcaccagagcgcacacttagtgcagtgttaagcaaatcaaaatgatgtgctgaatcaggaggttaataatgttatctgggcaaacgcctgcacgggtatggaacacacgacgtaccgagaaacagcgtcgtctggcttctgtcccggtagaaggcaaagtgctgccgaccgacgacctggtcgccatgctggaaaaacttatcgcacccggcgacaaagtggtgctggaaggcaataaccaaaaacaggcggattttctttcccgctcccttgcgcaagtcagcccgcaaaaagtgcacgatctgcacatgatcatgccaagcgttggccgcagcgaacacctcgatatttttgaaaagggcatcgcccgtaagctcgacttctcgttctccggtacgcaaagcctgcgcatttcgcagctgctggaagacggtcaactggaaatcggcgcgatccacacttacatcgaactctattcccgtctttatgtcgatctgtcgccgaacgtcgcgctgatcgccggctacaaagctgaccgcaaaggtaacctttacaccgggccgagcactgaagacactcctgcgctggtcgaagccgcagcgttccgtgacggcatcgtcatcgcccaggttaacgaactggtggatgacgaatgcgatttaccgcgtgtcgacatccccggctcctggatcgactacgtggtggtagcggacaaaccgttctttatcgaaccgctatttacccgcgatccgcgcctcatcaaacaggaacacatcctgatggcgatgatggcgatcaaaggcatttacgccgaacaccaggtgcagtcgctgaaccacggtatcggctttaataccgctgccatcgaactgctgctgcccacctacggcgaacagctggggctgaaaggcaaaatctgtaaacactggacgctgaacccgcacccgacgctgatcccggcgatcgaaagcggttgggtggagagtgtgcactgcttcggtggtgaactggggatggaagagtatatccgcgcccgtccggacattttctttaccggcgccgacggctccatgcgctccaaccgcgcgttctgccagctggcagggcagtacgcggtggatatgtttatcggttcgaccttacaggttgatggtttcgccaactcctcgaccgtaacccgcggtcgtctgtccggcttcggcggcgcgccaaacatggggcacgatccgcacggtcggcgtcatgccaccccggcgtggctcaacatgatcactgaacccgacccaatgcagcgcggtaaaaaactggtggtgcagatggtggaaaccttccaggcagggtcaaaaccgaccttcgtggaaaaactcgatgccatcgacgtggcgaaagcttccggcatgccactcgccccggtcatgatttatggcgatgacgtgacgcacgtactgacggaagaaggtatcgcttacctctaccgtgccgaaagcatggaagagcgtcgcgcgatggtcgccgccgttgccgggatcaccgatatcggtcttggcgtggacgcgaaacgcgtcgccgacctgcgccgcagcggcaaagtggtttatccggaagatattggcattcgccgcaccgacgccacccgttcgttgctggccgccggtagcgtggcggatctggtggaatggtctgacggtctttataacccgcctgcaaaattccggagctggtaatgaaacatctgccacagattgaagcttgcggaggtgccgaatggctggcgcgaaccgccacccagtgtctgattgacgaagcacggttaagcccgaagcccggtctggtggacagtcgggggaatggggcgcaccacgacctgacgctggcgctgatggagcgttccgcgcgtagcctgacccctacgtttcatgccctggcgcaacaaagctggcaacgtccggcagacattgcgctacgacaaactatcgggcgactgggtcgcgaaggcgaacagcagatgatggctgccaccggcggcgtgaatacgcaccgtggcgcgatctgggcgctgggcctgctggtcagcgcggcagcgatgctgggcggcgcgggcactgcggaggacattgcaaatgtcgccgcacagctggcgcaactgccggacgccgccgccccgaaagtcttcagcaagggcctgcgcgccacccatcgttatcgggtacccggcgcacgtgaagaagcgcagcagggttttccgcacatcgtccaactggcattgccgcagttgcaagccagccgtaaacgcggcggcactgaaacccaggcgcggcttgatgcgctgatggcgatcatgacctcgctcagcgatacctgcgtgctgaaccgcgccgggatgaccgggctggaaaccatgcgtgacggcgcaaaagccgtgctgtcagccggcggaacggcgcagcctgcgggccagcgcgcgctggcgcgacttgacgcgcagatgctggcgcttaacgcctcgccgggcggtgcggctgatttactcgccgccacgctgctgctcgaccgtatcgcgaccttgccttatttatctgattaagaggatgttatggaacacattacgatctctttgcctgccagccgcaccttgagcggtaaagcgctggcaggcgtcgttggctccggggatatggaggtgcttttcaccgccgaccaggagcagacgctcaccgttgatatcaccacttccgtggacaacagccgcggacgctgggaagcgctgtttaaccgtctcaccctggcgggcagcctgccgtccggcaagctggtgatccacgattttggtgcgacgcctggcgtggcgcgcattcgtatcgaacaggtttttgagggggtgagccatgcgtgatgaccgcagttttatcgaattaaaagcgcgtgaacgcgcccgcacgctgctggacgacggcagctaccgtgaattgctggatccctttgaaggcattatttccccgtggcttgggccgcagggcatcgtgccgcaggccgatgacggcatggtggtggcgaaaggcaccattaatggccagcctgcggtggtgatcgccatcgaaggcaccttccagggcggcagcatgggggaagtgtccggcgcgaaaatggcagcggcgctggagctggcggcggaagataaccgcaacggcatcccgacccaggcggtactgtgcctcgaaaccggcggcgtgcgtttacaggaagccaatctggggctggcggcgattgccgatattcatgccgccattgtcgatctgcgccgttatacgccggttatcggcattgtggccggtaccgtgggctgctttggcgggatgtccattgctgccgcgctgtgcagctatttaatcgtcacccgcgaggcgcgcctcggtcttaacggtccgcaggtcattgagcaggaagcggggattgaagagtatgactcccgcgaccgtccgtttatctggagcatgaccggcggggaagtccgctatcagagcgggctggtggatgcgctggttggcgacggggtgaatgcggtgaaaggcgcgatgaacgactttatcgccaaaggcgtaccggaaaaacaccgcaccgataactaccagtggtatctggatcgtctcacccagttcgacacccgcaaacaggcggatgccgaacagatcaaagcgctctttgccggggaggaaaaagcatgaatacgacagtaagccgtggcgcattatggcttgaaaaactggcgcccaacgcaccacgtttgagcgggttatgcccgtcggtccaggtggctgacggtgaaattaacggtgaagcggcacgctttatcgccgtggtcccggatacgcataaccactatccccgcgcggcaaacggtgaagtcggtctgctggaaggctggacgctggcgaaagtggttagcgaaaccatcgccgccgacgccggtaaaagcgttaaacgcccgatcgtggcggtgattgacgtaccgagtcaggcctatggccgccgggaagaaggttttggcattcatcaggcgctggccggtgcggcaggggcttatgccaatgcccgtctggcaggtcacccggtgattggccttatcgttggtaaagccatgtccggtgcgtttctggcgcacggctaccaggcgaaccgtctgattgccttcaacgacaacggcgtgctgatccacgcgatgggtaaagagtctgccgcgcgtatcacgctgcgtaccgttgacgcgctggaaaaactggcggcgaccattccgccaatggcgtatgacatcagtaattacgccacgctggggctgctggatcatctgctgaacatcagcaatccggaagcgccttccgatgccgatctggcggaggtgaataccaccctgcaacaggccattcacgacgcacgtcaggacaccacgcttaaaaaccgtcttggtgccgacaaccgtcgcagctcgtcactcgtgcgggagcgcatgcgcgcaagctggtaagaagtaaaaaagacctgccggaatgaccgccccgtgggcacatacgctgtgcccatgaggaagcgtgcatctgaaaaataacaaacatcgcgtcagtgctatttccttgtttatctataggtgatttatgacttacgtaattgttcatgctctcgcaccgatttttgtgattatgctactgggattctgggccggtaaggccggaatggtggataacaaaaatgtttccctgcttaatattttcgtgatggattttgccctgcccgccgcgctgttcagcgccacggtgcagacgccgtgggacggtattgtcgcccagtcgccgctgatcgtggtgctgacgctggcgatgtggatcacctacgccatcatctatttcctcgccaccagcgtctttaaaaaatcgccgcaggatgctgctgtgctgaccctgaccgttgccctgccgaactatgcggcgctgggcctgccgatcctgggcagcgtgctgggtgaaacctcgtctacctcactctccgtggcggtatccattgcctgcggttccgtgctgatgacgccgttctgcctgctgatccttgaacgtgaaaaagcgcgtgcggaaggcggtaacagcggttcaaccctggcgatgctgccggtgctgatgtggcggtcgattaaaaaacctatcgtcatgggcccgctgttaggggtgattttatccgccatcggtattcatatgccggatctggtgctggcggccattaaaccgctgggcctgtccgccactgcggcggcgctgttcctgaccggcgtgatcctctcggcgcgtaaactgcaaatcaacaccatggttattacctcgaccatcgctaaactgctgatccagccagccattgcctgggggatcgtgctggcgttaggcctgtccggcccggttgccattaccgctatcctgatgatcgcgctttcggccggtttcttcggcgtggtcttcggtaaccgctttggcgtacagtcgccggatgccgaagccgtgctgttgttaagctctgtgctgtgtattctgtctctgccgctgtttatctcgctgacatcaggaatgtaaaacatgacttcatcatcattgcgaccgcacgatcttctctggctggctgaccgcagcgccctgcagggggtgacggaatcctgggtggatacggtctggcatgcggggttgccggtagtggtgcggcgtgatgttgatgagcaggggcgcatcccggtgggggtgcgcggtctgcgccgcgaccagcgtgcgccaggctgggtggatgcgcagcaggttgtgcgcgttgtcacccccgaacagctgaccgacgcccgggcgctggtcagctcgccctttatctccgcgccacccgttcaggtggcgtttcagctggcgcagcatgggtggccgtgggtctgggggatcaccggcagcgtcggctatgcgctggcgaccggcatcccggtgatccatgccgcaagcgatctggatctgctgatccgcgccccgcagccgctgtcgcacgatgcgctgatacagtggcagcaacggctggacaccgccctgtgccgcgccgatacgcaggtggagacgccatccggcggattcgcgctcaatgagtggctgcgtgacggtcaggcactgctcaaaacccgtcagggaccgcgtctggttagcgatctctggcgcagggaggactaatgaaaattctgtttacctttcccggccagggaacgcagcatcccggcatgttgcaacagctgcccggtacggcgcttgcagaagcgcgtgaagtgctgggcgcggaagtcgataccctggatatgcctgaagcgctggagcatacccgcgcggtgcagctgtcgctgttgatcgccggtgtcgcctgggcgcgggaactgcaacggcagggcgtggagccagatatcgtcagcggcctgtcgatcggcgcgtacccggcggcggtggtggccggtgcgctggcttttgacgatgcgctgcggctggtggccctgcgcggcgatttgatggagcaggcgtacccgcacggttacggactgacagccatcatgggtctgacgctgccgcaggtcgaagcaataagcgaaggcagccagacctggatcgccaacctgaatgcggaaacgcagattgtgatcgccggtcgtgatgaagagatggcgcaggtggcggaaaaagcgctggcgaaaggggccagcaaggcgaagcgtctggctgtcagcgtgccgtcgcactgtgaactgctgacccgtccggcggaaaaactggcacaggcctttgccggggtgagtttgtcccgtccggcgtgcgcttacctgagcggcagtaccggacgcgtgctgtggcagccggagaaaatcgccgacgatctggcgatgaacatggcgcgtaccgtacgctggcaggaggcggtgatttccgccaatgagcgtgaagcgcggctggccatcgagatgccaccgggcggtattctcacctgtttaacgcggcaggcggcctgggaaggggagtccatttcgctggagcgcagcggcgttgatgtggcgctgcacctggcgaaacgtctgcgggagcagcgataacgcattgcccggcggcgcaggcttgccgggcctacaacgacatagcttgcagatcgcgtaggccgggtcaggcgcagccgccacccggcaaaagggtccgtcataaaattatgcaggtcagataagcgaagcgccacccgacaggttcaactcagccacccggttcctgcaaactgcgggcgtacatgcggccttcggcggcgagcgccagcagattcggatcgtgctcgcggttgcgaggaaagacgatggcgatcaactgctgcatctggtacggctcggcgagctttaacagctgcaccgagttttcatacactttcttcatgcggcccggcatcagggtaaaaccaacgcctgcctgcaccagactcagcatcgagaaaatgtcgtttacgcgcgtaacgatctccggctcaaaaccggcaatgtgaaaggcttcctgaaagcctgcgtaggtggcgaaaccttccgccagcgagacaaatttttgctggcggtaatcgcgtaaatcggcaggtgctgacatgttgagcgtggccgacgcgggcgcggcgaggaaaatatcatcgtgaaacagcggcaacacttcgaggctgttgcgatcgatttgcgcctctgacagcgaaatgataatcgcgtccagctccccggcgtccagcatgtgcagcagggtttcgttagaacccatggtcagcgccatctccagctccggccggcgcagcttcatgcccatgatcagacgcggcacggtttccagcgtcagcgagtagagcgtgccgacacgcagccgcccctggccgacgcctgcttctttgcgcgcctcttccagaccacgcgtcatcagttgcgtgacttcctgacaatactccagcagcgtccaggccgcgggcagcggcatcagggtgcgacctttatgcacgaacagtgggcagcgcacgttttcttccagcgtatgcagcgcgcgatgtacgctcacgccgcttaacgccagcgcttctgcggtgcgggcaatgttccccttttccataaaggtcatgaaaatggcgagcttgcgaaacgtgatctcactgaggatgtcgtggctcatggtcagtcgctttgcagcatagcctccagctgttcctgggcgtccagccatgccatttcacactcttcaagcccggctttcgcgctggcctgcgcctgtaaacaggcggtgagttcggctttgcggctctggtcgtacagcccgctgtcgctcagtttttcttccgccgcggcctgctgtgcctggaacttctccatctctttttccagacgggcgatctctttgcgcagcggctgcgtctgggtgcgcagttccgcttcgcggcgcttctgatctttacgcgactgggcgctgttggcgttctctttcgcgccttcggcaggctggttttccagtttctggatgtcgctcagccactgctgatagtcttccagatcgccgtcgaaggcctcgactttaccgccgtgcaccagataaaactcatcggtggtggagcgtaacaggtgacgatcgtgcgacaccaccaccagcgcgccttcgaattcgatcagcgcttcggtgagcgcctggcgcatatccagatccaggtggttggtcggttcatcgagcagcagcaggttagggcgctgccagacgatgagcgccagcaccagacgggctttttcgccgccggagaagcggccggtcacttcactgactttatcgccctggaaaccgaagccgccgaggtaatcgcgcagcttctgctccagctcctgcggcgcaatgcgcgccaggtgctggattggggattcatccgcgcgtaaaaattccagctgatgctgggcgaagtaacccagcttgatacctttcgccagaccaatctcaccgcttaccgggtttagctcgcccgccagtaatttgatcagcgtcgatttacccgcgccgttacgccccagcagaccgatgcgcgaaccgggaaccaggttgagcttgatggaatcaagaatggtgcgatcgccataaccggcgctgaccttttccattttcagcaacggattcggcaggctttcaggggcgcggaagctgaagtggaacgggttatccacgtgcgccggggcgataagctccatgcgctccagcattttcacgcggctttgcgcctgtttggctttgctggctttggctttgaaacgatcgataaagctttgcagatgcgccacccgcgcctgctggctttcgtaagtggcctgttgctgggcaaggcgcgtcgcgcgctggcgctcgaaggcgctgtagttgccggtgtattcgaacatgttttgctgttcgatatggataattttgtccaccaccggatcgaggaaatcacggtcgtgagaaatcaaaatcagcgtgccctgatagcttttcagccatttctccagccagatcaccgcgtcgagatcaaggtggttggtgggttcatcgagcagcagtaaatcggaacggcaaatcagcgcctgcgccaggtttagacgcatacgccagccgccggagaagtcgctcaccgggcgctcaagctgttcatttgaaaaaccgaggccgtgcagcaggctggacgcgcgggagcggatggtccaggcgtcgatggcgtcgagcttgccgtgcaccgtggcaatcgcgtgcccatcgttacgttcgttagcggcgttgagctcagcttcaaactgccggtactggcggtcgccgtcaatcacgtaatccagcgcgggttcgctcagcgccggggtttcctgattaacccacgccagctgccagtttgccggataggtgaagctgccgccgtcggcgctgagttcattttttaacagcgccagcagcgtggatttcccgcagccgttttttcccaccagtccgaccttctggccgggattgatggtggcagtggcattgtccagcaggacgcgtacgccgcgacgaatttgtaacgaggagaaaacaatcatagagcgccgttatgttccgactatattaatttgtcattatgatattttagggtagtgggcaatgtgccgcaccggggcgccatggtagcccaaaacgaagcctggacacaaaatcattagaatgacgtgcacgacgcccgggaggggaatgatgccaccaacagcgaaagtattgctgttatatgcccatccggaatccggagattcggtcgccaaccggctcttacttaaaccggcaacgcaactcagtaatgtcaccgtgcatgatctctatgcgcattaccctgatttctttattgatattccccatgagcaggcgctgctgcgcgagcatgatgtgatcgtgtttcagcatcccctctatacctatagctgtccggcgctgctgaaagagtggctggatcgcgtactgagccgcggctttgccagcgggccggggggaaatcaactggcgggaaagtactggcgtagcgtcattacgaccggtgagccggagagtgcttaccgctatgacgcccttaaccgctatccgatgagcgatattctgcgccccttcgaactgacggcggccatgtgcaaaatgcactggcttacgccgatgattatctatcatgcgcgtcggcaaccgccggaggagctggcgagccatgccagagcttacggtgactggctggcggcgcctgtcgccacaggaggcctgtgatggaaggttccgatctgttactggcaggcgtgctgttcctgtttgccgccgtggcggcggtaccgctggcggcgagactgggcatcggcgcggtgctgggttatctgctggcggggattgccatcgggccgtggggcctcgggtttatcagcgatgtggatgaaattctgcatttctccgagcttggcgtggtgttcctgatgtttatcatcggcctggagctgaacccgtccaaactgtggcaactgcggcaatcgattttcggtatcggggcggcgcaggtgttgctgagcgcggcgatcctcgccgggctgctgatgttgacggagttttcgtggcaggcggcggtgatcggcggcctggggctggcgatgtcctcaacggccatggcgttgcagttgatgcgcgataaaggcatgaaccgcaacgaaggcggccagctcggattctcggtgttgctgttccaggatctggctgtgatcccggcgctggcgctggcgccgctgctggcgggtaacgccgatgaacatctggactggatgaaaatcggcatgaaagtgctggccttcggcgggatgctggtgggcggtcgttatctgctgcgtccggtgtttcgttatattgccggttccggcgtgcgggaggtgtttaccgccgccacgctgttgctggtgctgggttcggcgctatttatggacgctctcgggctgtcgatggcgctgggcacttttatcgccggggtgctgctggcggaaagcgagtaccgtcatgagctggaaatggctatcgatccctttaaggggctgctgctggggctgttttttatctccgtcggcatgtcgctcaatttaggcattctttatacccatctgctgtgggtgctggtcagcgtcattgtgctggtggtggtgaaagggctggtgctgtacggcctggcgcgcctgtacggactgcggcgttccgagcggatgcagtttgccggggtgctcagccagggcggggagtttgcttttgtgctcttttcggcggcgtcatcccaaagattgttccacaatgatcagatggccctgctactggtgacggtgacgctgtcgatgatgaccacgccgctggtgatgaaaatcgtcgataaacagctgtcacggcactttaacggcccggaagatgaggacgaagcgccgtgggtagaggatgataagccgcaggtgattgttgtcggctttgggcgtttcggtcaggtgatcgggcgtctgctgatggcgaacaaaatgcgcatcacggtgctggagcgggatatcagcgcagtcaacctgatgcgaaaatacggctacaaagtctattacggcgatgccactcaggtggagctgctgcgctcggcgggcgcggaggcggcgaagtctatcgtcatcacctgtaatgagccggaagacaccatgaagctggtggaaatctgccagcagcacttcccgcatctggcgatcctcgcccgtgcgcgtggccgtgtggaagcgcatgaactgttacaggcgggcgtgacgcagttctcccgcgaaaccttctccagtgcgctggagctgggacgcaaggcgctgattacgctgggcgtgcatccccatcaggcccagcgcgcgcagctgcacttccgccgtctggatatgcgcatgttgcgcgaactgatgccggtgcatactgatacggcccaaatctcccgcgtccgggaagcgcgccgcgagctggaagagattttccagcgcgagatgcagcaggagcggcggcagtttgacggctgggatgaattcgagtgaggcaaaattatgacaatacgtaaacgctttatcgccggtgcgaaatgcccggcctgccaggcgcaggatacgctggccatgtggcgggaaaataatgttgatgtcgttgagtgtgttaagtgcggtcatcagatgcgcgaagcggataaagaagcccgcgagcatgttcgcaaagaagagcaagtgatcggcatttttcatccggactagcgatataccccagctttttttatgcttaagggtacacaggggcagaattccgttacaatctgcgccagcaattttcccacgctcaggagatatcatgaaagtagcaaaagacctggtggtcagcctggcctatcaggtacgtacagaagacggtgtattggttgatgagtctccggtgagtgcgccgctggactacctgcacggtcacggttccctgatctctggtctggaaaccgcgctggaaggtcacgaacctggcgacaaatttgatgtagctgttaccgcaaacgaagcttacggtcagtacgacgacaatctggtacagcgcgtaccgaaagatgtcttcatgggcgttgacgagctgcaggttggcatgcgtttcctggctgaaactgaccagggtccggtaccggttgaaatcactgaagtggaagacgatcacgttgtggttgacggtaaccatatgctggccggtcagaacctgaagttcaacgttgaagtggttgccattcgtgaagcaacggcagaagaactggctcacggccacgttcacggtgcccacgatcatcatcacgaccatgaacacggtgacggttgctgcggcggccatggccacgatcacggtcatgaccacgaccacggtaaaggtggttgcggcggtcacggcggctgcggttgccactaatgcgttagcgctccggcgctgtacgatcaaaaaagcgggatcttcccgctttttttacgccttaatagtggggcggcggcgtctcttctgactgggacgcgatgtgcgatggctggctggctttgagtttgtctgccatcaaacgcagatgctcgcgcattttcgccatctccagttcatgggcggtgaccgtgaggttgagttcttcaatggttatttcctgaaaagccagacgactttccagttctgccagtcgcgcttccagcgtcatttcctgcatcattcacctcttttgtcgtcgttgttatcgggccaggcggcgggcggattctactgaagtttacgccctcgcgcagcaaccggacgtcctgaagaaactaatttaaacaaaaatagtctcaaaagaagcgattatcggggaagtccatatgttgattttctccgcaacgttttatagtacgcttcttaataagttaacaagggggatccccccggccctggagaaatggatgaaatcactgttaaaagtaacgctgctggcaacgacgatggctgtcgcattgaatgctccgctgaccttcgctgcggataccgctgcgaaagccgcacctgcggcagacagcaagtctgcattcaaaaatgatgaccagaaatcggcttatgcgcttggcgcatcgctgggtcgttacatggaaaactccctgaaagaacaggaaaaactgggtatcaagctggataaagatcagctgatcgcgggtgttcaggacgcctttgctgataagagcaaattgtccgatcaggaaattgaacagaccttacaggctttcgaaacgcgtgtgaaatcttctgctcaggcgaagatggacaaagacgcagcagataacgaaaacaaaggtaaagcttaccgcgacacctttgctaaagagaaaggcgtgaaaacctcctctaccggcctgctttacaaagtagagaaagaaggcaccggcgatgcgccgaaagacagcgacaccgtagtcgtgaactacaaaggtacgctgatcgacggtaaagagttcgacaactcctacacccgtggcgagccgctgtcattccgtctggacggcgtgatcccaggctggactgaaggcctgaaaaacatcaagaaaggcggcaaaatcaagctggttatcccaccggcgctggcttacggtaaaaacggcgttccgggtatcccggctaactccaccttggtctttgatgttgagctgttagacatcaaaccagcaccgaaagcggaagcgcaggcggaagccgcaccggctgaaaaagcagctgacgcggataagaagtaagcacgctgaaagccgccgcctgaatgggcggcggttttttattgcagggccgatatatactctacctgacgcgtctgtgtcctacagcgccgcggagttaattaacgctggcaagcattgcccgcgctgtattaacttagttgtccgtgtaaatgatgagcctgccctgaaaagttaacgacaggctcctgaaaaggagtgttttttttcatgtccaggtcgctattaaccaacgaaaccagtgagcttgatttgctggatcaacgtcccttcgatcagactgacttcgatatcctcaaatcctacgaagcggtagtggacgggttagcgatgctcattggctcccactgtgaaattgtattgcactcgttgcaggatcttaaatgctccgccattcgcattgctaacggtgaacacaccggccgcaaaatcggatcgccgatcaccgatcttgccctgcgtatgctgcatgacatgaccggtgcggatagcagcgtctccaaatgctattttacgcgcgccaaaagcggcgtactgatgaagtctgaaactatcgccatccgcaaccgtaaccagcgggttatcggtttgctgtgtatcaacatgaatctcgatgtgccgttctcacagattatgagcacctttgtgccgccggaaacgccggacgtcagttcgtccgttaacttcgcctcctcggtggaagatctggtcacgcaaacgctggagttcaccatcgaagaagttaacgccgatcgcaacgtctctaataacgcaaaaaatcgtcagatcgttttgaatctttacgaaaaaggcattttcgatatcaaggacgccattaatcaggtggcagaccgtctgaacatctccaagcacacggtttatctctatattcgccagttcaaaagcggcgatttcctggggcaagagaagtaatgcgtttcgccattctcgtcacaggccctgcctatggcacgcagcaggccagcagcgcgtggcagtttgcccgggcggtgctggctgccggtcatgaactggtcagcgtgtttttctatcgtgaaggcgtttataacgccaatcagcttactgccccggccagcgatgaattcgatctggtgcgtgcctggcaacagttgcagacggagcatcaggtggcgctgcatatctgcgtggcggccgcgctgcgtcgtggcgtgacggacgaaaccgaagcccgccgtctgggactgtccggcgcgaatttacagccgggctttgtgctgagcggcctgggctcgctggcagaagccgcgctgacctgcgatcgaatggtgcaattctgatgaaatctgtcgcttttgtgtttaagactgcgccgcacggctcagcggcaggacgggaagggctggatgcgctgctggcgatgtcggcgctgactgaagagatcggcgtcttttttatcggcgatggcgtattccagttgctgaaagaacagcagcccgctgcgatcctggcgcgtgactacatcgccaccttcaaggtgctgccattatatgacatcgaacagtgctggctgtgcgcggcctcgctacgggagcggggcttatccgcctccacgccgctgatcctggacgcacaggcgcttgaaccggatacgctgcgtgcccggctcaatgattttgatgtggttatgacgttctgaggcccttatgctgcataccttgcaccactctccctggcagtgtgatatgaccatgctactgcgtaccatgcaggccggggacgatctcttacttttgtccgacggggtagttgctggcattgaaggcgggcattaccttgatttactgctggccgcccccatatcggttcatgcgctcaacgaagacgtcgtcgcgcgcggcctttctggtcaaatttcgaacaatattgccagggttagctatactgaattcgtcagcctgacggtaaaacatgccgttcagatgtcctggtagtgtggatcgctgtatatttcttgacaccttttcagcacagctctaaaattctgcgtcctcatattgtatgaggtcgatttattacgtgtttacgaagcaaaagctaaaaccaggagctatttaatggcaacagttaaccagctggtacgcaaaccacgcgctcgcaaagttgcaaaaagcaacgtgcctgcgctggaagcatgcccgcaaaaacgtggtgtatgtactcgtgtgtacactactaccccgaaaaaaccgaactccgcactgcgtaaagtttgccgtgttcgtctgacaaacggttttgaagtgacttcctacatcggtggtgaaggtcacaacctgcaggagcactccgtgatcctgatccgtggcggtcgtgtaaaagacctcccgggtgttcgttaccacaccgttcgtggtgcgctcgactgctccggcgttaaagaccgtaagcaatcacgctccaagtatggcgtgaaacgtcctaaggcttaatggttctccgttaagtaaggccaaacgttttatattaatgtcaaactaaactctttgagttttggacaatcctgaattaacaacggagtatttccatgccacgtcgtcgcgtcattggtcagcgtaaaattctgccggatcctaagttcggatcagaactgctggctaaatttgtaaatatcctgatggtagatggtaaaaaatctactgcagaatccatcgtctacactgctcttgagaccctggctcaacgtagcggtaaaggccacctggaagcgttcgaagttgctctcgaaaacgtgcgtccgactgtagaagttaagtcccgtcgcgttggtggttcaacttatcaggttccagttgaagtacgtccggttcgtcgcaatgctctggcaatgcgttggatcgttgaagctgctcgtaaacgcggtgataaatccatggctctccgcctggcgaacgaactttctgatgctgcagagaacaaaggtactgcagttaagaaacgtgaagacgttcaccgtatggcagaagccaacaaggcgttcgcacactaccgttggtaatcccttcggagtattagtcaccaggcgggcgcttcataaaagctgcccgctttgggctacttaaattgaacgccaaaggcaatagaggaatcaaatggctcgtacaacacccattgcacgctaccgtaacatcggtatcagtgcgcacatcgacgccggtaaaaccactactaccgaacgtattctgttctacaccggtgtaaaccataaaatcggtgaagttcatgacggcgcagcaactatggactggatggaacaggagcaggagcgtggtatcaccattacctccgctgcgactaccgcattctggtctggtatggcgaagcagtatgaaccgcatcgcgtaaacatcatcgacaccccgggccacgttgacttcaccatcgaagtagaacgttccatgcgtgttcttgacggtgctgtaatggtttactgcgcagttggtggtgttcagccgcagtctgaaaccgtatggcgtcaggcaaacaaatataaagttccgcgtattgcgttcgttaacaaaatggaccgcatgggcgctaacttcctgaaagttgttggtcagatcaaatcccgtctgggcgcgaacccggttccgctgcagctggcgattggtgctgaagaaggcttcaccggcgttatcgacctggtgaaaatgaaagccatcaactggaacgatgccgaccagggcgtgaccttcgaatacgaagacatccctgcggacatggctgacctggctgaagaatggcaccagaatctgatcgaatctgctgctgaagcttctgaagagctgatggaaaaatacctgggcggcgaagagctgaccgaggaagaaatcaaatctgctctgcgtcagcgcgttctgaacaacgaaatcatcctggtaacctgtggttctgcatttaagaacaaaggtgttcaggcgatgctggatgcggtaattgattacctgccagcaccgacagacgtaccggcaattaacggtatgctggacgacggtaaagacacgccggctgagcgtcacgcaagtgatgacgagccgttcgctgctctggcgttcaaaattgctaccgacccgttcgtgggtaacctgaccttcttccgcgtgtactctggcgtggttaactccggtgataccgtagtgaactccgttaaagctgctcgtgagcgttttggccgtatcgttcagatgcacgctaacaaacgtgaagagatcaaagaagttcgcgcgggcgacattgctgcggcaatcggtctgaaagacgtgactactggtgataccctgtgtgatccggagcatccgatcattctggaacgtatggaattcccggagccggtaatctccatcgccgtagaaccgaaaaccaaagctgaccaggaaaaaatgggtctggctctgggccgtctggctaaagaagacccgtctttccgcgtatggactgacgaagaatctaaccagactatcatcgctggtatgggtgaacttcacctggacatcatcgttgaccgtatgaagcgtgagttcaacgttgaagctaacgtgggtaaacctcaggttgcttaccgcgaagcgattcgcgcgaaagttaccgacattgaaggtaaacacgctaagcagtctggtggtcgtggtcagtacggtcacgttgtgatcgacatgtacccgctggagccgggctcaaatccgaaaggttatgagttcatcaacgacattaaaggtggtgtgattcctggcgaatatatcccggccgttgataaaggtatccaggagcagctgaagtctggtccgctggctggttatccggtagtagatctgggcgtgcgtctgcacttcggttcttaccatgacgttgactcctctgaactggcgtttaaactggctgcgtctatcgcctttaaagatggctttaagaaagcaaaacctgttctgcttgagccaatcatgaaggttgaagtagaaacgccggaagagaacactggtgacgtcatcggtgacttgagccgtcgtcgtggtatgctgcgcggtcaggaatctgacgtgactggcgttaagatccacgctgaagttccgctgtctgaaatgttcggatatgcgactcagctgcgttctctgaccaaaggtcgtgcatcatacacgatggaattcctgaagtatgatgatgccccgaacaacgttgctcaggccgtaattgaagcccgcggcaaataagcccaggttttaaaacattgatcccgtgctccctccttgaggggggagcactatagtaaggaatatagccgtgtctaaagaaaaatttgaacgtacaaaaccgcacgttaacgtgggcaccatcggccacgttgaccacggtaaaactactctgaccgctgcaatcactaccgttctggctaaaacctacggtggttctgctcgtgcattcgaccagatcgataacgcgccggaagaaaaagctcgtggtatcaccatcaacacttcccacgttgaatacgacaccccgactcgccactacgcacacgtagactgcccgggccacgccgactatgttaaaaacatgatcaccggtgctgctcagatggatggcgcaatcctggttgttgctgcga

SEQ ID NO: 5 - DNA, 131835 bp, Enterobacter sp SA187
gaattacgtatgttcactccagagacttggtattcatttagcgtccgaagacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaagaagaccttctgacccggtggcctgtaagccgttgttccgtgtcagtggtggcgcattatagggagttattccgggctgacaacccctaaattcaaaaaatttatcaaccgtctcttttttgctcaaaaacgtcctgaaccgccagtttttcgagcattttgaagccatagcgctgcaaaacgggcagtaattgtacggcttcaggcgtggcctccatacagaacgcgatattttcatccgccgatttcgcatcaggcgcgtcatgctctaatagccataccgtgcgacgcgcaatggccgcaccggaatccaccagccgggtgccgtcaggtaaaacctgtagcagctcctcgcgcagcagggggaaatgcgtacagcctaacaccacggtatccggcggttccggcatccgcagccacgggcgcagaatgcgcttcaggttttcaagcggaacaggtttaccgtgcagcttggcttccgccagctcaaccagctctgatgaacccagcatttcgatatggcattcattcgcgaaacgctggatgagttcatgcgtataaggacgctttaccgtgccgcgcgttgccagtaagccgacgatgccgttagccgtcagtcgcgccgcaggtttgatggcgggaaccactcccacaaccgggaactggaatttttcgcgcagagcaggaagggaaacggtgctggcggtgttgcaggcaatgatggccattgccaggggatagcgcgcctgaacagcagtgacaatgttcagcacccgctccacgataaaggcttcgcttttttccccgtaagggaaagccacattatcgaaggcataaatgtaatgcagatccggcagcagttgccggatctcatcatagaccgataacccaccgacgccggagtcaaacaccagcacggtaggtttgaggtcagaaggtgtagctgccagacaagttgtattctcgtcctgcagtttggtagccataagctgtctcgtaatctttatcgaacaggttagctattttaccacgaactgtaagatgagaggtgacaggatatgacgctgtgacatccacggtgctgtaactcggcagcctttgctgcacgttattgtactccgaggtattgttgtcataacgcttgccaaaatattgccaggaaacgtccatacctacgtcaaacatcgtccagtcgagctgatacttcgcctgctgccgggaacggcgcgccagcacttcatcgttttcatcattacgcggatcgacatattgcagcgtcacgcgatggttgaaaatgccggtatcgaaactccccgtccattccacgcctttaatggtggcagagttaatattgtcgtacgcgccggcaaaggtcaccggatcggaatagtaggtgatcagattgctgatttcgtagcgataggccgacaggcgccagtccagcggcccggtcagaccttcaagccccgcctcccactgttttgactcttccggcttcagattcgggttggaatcaataccgaaacgggttgagccgaactgctgccccagcgacggcgcaaggaaccctgtaccgtaggaaagggttaagcggtaatcctcaacaaactcccagcctgcggcggtctgccaggtaccgtgccagccaaattgctcatcatgatcttcacgaccagaggcttccagcgtcacgtcgccaaactgctgctgcccggtaagatacagaccggtatcatcgcgcttataggtatctgacgttgcggtatcggaagacgtcaggcgttgctgctgccagtcgacgccgccgctcaccgagccatggccgacgataaggttattaccccattgcagattacgctgctccagacggtccagcgaagagccgtcctgataacggccataaatgctgctgtagttgtaatctttgattttctgatagctggcaatgagctgcgaagagtaaatgccggagtgatattccagaccggtatcccaggtctggttataaagctgattttcatcggcgctgtaagctggcatgaacggcgggctgccaagatcgtaatcgacgttattggcatagctatggccacggaagaagccattgaagttgtcgttaaacttatgctcgacgctgccccagaacgttttgttgtggtagccgtcgcggtcattgtcgtgatcccagctggagccaggctgcacattaaagccacgggtgctttcgtaagaacctgccagcgtcgccagggtatcgccgaaacgctgacgcagcgcgccatcgtactgctgatagcctttcgagcctacgctggcggtaattttcgactgttcttcatcgcttcgggtaatgacgttaatcacgccgcccatcgcgccggaaccataaatcgccgaacgcggaccgcgaatgtattcgatacgctgcaccagggacaccgggatttggttgagatcgggattattggtgatgcctggtcgccccatcgggataccatccaccagcaccagcacctgtcgcccttcggtaccgcgaacgtacagcgtggagttttgtttcatcccgccgttctgcgcaatatccacgcccggtaaacgacgcatcacatcattgagggtttttgcctgccagcggtcaatctcttcacgggtcacaacatccgtaggtgccagtaccgtgccaacgggctgctgaaaacgatttgcggtgacgacaacgttgtccgggttgctatcctgcgcccagccagaaaatgccgtgacggagagcgccgtcagcagcgaagtttttttaatcattgttaaagcatccacaatataagaaggatgccgcaggccccatcgatagcacgcgatgatgtgaaccaaatgcgacgttaaccggcaggtcttcgggctcgaaagtacaacagatgatgacttcccaccttacggcagtgtctgctttcgctatcacccttaacttcttaccgctgcgcgtcagctccagatttgcactggattcccttttaactcaggagaccggaaagcggatgctacatttagttacatatagatgtccagactgctaattaagaaatccgaaaaccgcagggctggacaatacgcacacaatccctacaatccccgcgtaattcaatcttactcaggacgcaccatgaccccagaacacctcccaacagaacagtacgacgcgcaactggccgaaaaagtcgtccgactgcaaagtatgatgacgccttttgccgcgccggttccggaggtgttccgttccccggtcagccattaccgtatgcgtgccgaattccgcatctggcatgacggtgacgacctgtatcacatcatcttcgaccagcagacgaaaaaccgtattcgcgtcgacagcttcccggcggccagcgagctgattaaccagctgatgcgcgccatgatggagggcgtacgccactccccggttttgcgtcataagctgttccagatcgattacctcaccaccctcagcaatcaggccgtggtatcgctgctgtaccataagaagctggatgatgcctggcgcgaacaggccgaagccctgcgcgatgcgctgcgggcgcagaacctgaacgtgcacattattggtcgcgccacgaaaaccaaaatcgcgctggatcaggattatatcgacgagcgactgccggtcgccggcaaagagatgatctatcgtcaggtagagaacagcttcacgcagcctaacgcggccatgaacattcagatgctggaatgggcgctgaacgccacaaaaaattcgacgggggatttgctggagctgtactgcggaaacggcaacttctcgctggcgctggcgcgcaacttcgatcgggtactggcgacggaaatcgccaagccgtcagtggcggcagcacaatacaatattgccgctaaccacattgataatgtgcagattatccgcatggcggcagaagagtttacccaggcgatgaacggcgtgcgggaatttaaccggctgcaggggatcgatctgaaaagctatcagtgcgagacgattttcgttgatcctccgcgtagcgggctggacagcgaaaccgagaagatggtgcaggcgtacccgcgtattctgtacatttcctgtaacccggaaaccttatgcaggaacctggagacgctgagccagacgcacaatattgaacgtctggccctgttcgatcagttcccgtacacgcaccatatggagtgcggcgtactgttgacccgtaagtaagcggcttattccggcagttcatgcctgcggttacgcaggcgataaccgatccagaataccagcgccacggagagcaccgcaggcacgaagttagagccgatagccggatactctgcgcgcaccacggcgctgtaaagcagcacgccaaggatgaaacacgccgccgccagaccgggtaaacccaccggcatggtacggttctgataacgctgatgcagacagtacaccgtcagcaccagcgcaataatcgggaagatggaaaacggcacaacagaactgaaaatggcggtaaaggtgccattgatggacaggccagcgatcagcgccagcagcaatgtacctttatcttgaactgtctgtttcattactcatccttcactcatcgggttgttgcgaaattttctcttgttcacggcgataccagtaatacgcgcctttggaaatcatccgcagctgtaaaaccagtcgctcttctaattgccgacgttgttccacgccaatatctaatgcttcagcgcctgcgttaaagacgatagtgaccatcgcttcggcctgcgcttcggtgaacgcccgcggcatatggttttcgagttcgagataatcggcaagttccgcaataaagtgctgaatttcacgcgccaccgcggcacgaaacgccgccgacgtgccggagcgttcccgcagcagtagacgaaaagcattagggttattgccgataaattccataaaggtggacaccgacgtgcggatcacgctgccgcctttggcgatacgctgacgcgcctggcgcatcagctggcgcagcatcagcccgctttcatccaccatggtcaggccgagttcatccacatcgcggaaatggcgataaaaagaggtcggcgcaatacccgcctcgcgcgccacttcgcgcaggctgaggctggcaaaactacgctcagcgcttaattgactaaatgccgcttctaccagcgaacgccgggtgcgttctttttgttgcgctctaacgcccatcacgatgtctgaatccttccaaaggcccgatggcactataccagacaataaaactaatcggtttacattgctttgtgaatgattgtttacgggcagtttgtgctttggcttcgcaaaaaagcacaacgataattgggttaaagcggggcaaatgttatcattgtgtttattttgtgtataaaaacaggtgagtaataccatgtcacattcctgggattacgatgcaatagtgataggctccggcccaggcggcgaaggcgcggcaatgggtctggttaaacagggagcacgggtcgcggttatcgaacgctaccacaacgtgggcggcggctgtacgcactggggcaccatcccttccaaggcgcttcgccatgccgtcagccgtatcattgaattcaaccagaacccgctgtacagcgaccattcccgccttcttcgttcctcctttgccgacatcctcaatcatgccgacagcgtgattaaccagcagacccgcatgcgtcagggcttctatgaacgcaatcattgcgagatcctgcagggcaacgcgcattttgtcgacgatcatacgctggcgctggagtgcccggacggcacagtggaaacgctgaccgccgaaaaattcgtcattgcctgcggctcgcgcccgtaccatccggcagacgtcgattttgcgcatccacgcgtgtacgacagcgactcgatcctcagccttcagcatgaaccgcgccatgtgatcatctatggcgccggggtaatcggctgcgaatacgcgtcgatcttccggggaatggaggtcaaagttgatctgatcaacacccgtgatcgtctgctggcgttcctcgatcaggagatgtcagatgccctctcctatcacttctggaataacggcgtggttattcgccacaatgaagaatacgagcgcatcgaaggcacggatgatggggtgattatgcaccttaaatccggcaaaaagcttaaagcggattgcctgctctacgcgaacggccgcaccggtaacgtggactcgctggcgctggaaaacatcggtttacaggcggatggacgtggcctgctgaaagtgaacagcatgtaccagacggcgctgccgcacgtgtatgccgtcggcgatgtgattggctacccgagcctggcgtctgccgcttacgatcagggccgtatcgccgcgcaggcgatggtaaaaggcgaagccagcgcgcatctggtggaagacattcctaccggcatctacaccattccggagatcagctcggtcgggaaaaccgaacagcagctcaccgccatgaaagtgccttacgaagtggggcgtgcgcagtttaaacacctggcgcgcgcgcagatcgtcggcatgagcgtcggcacgctgaaaattctgttccaccgcgagaccaaagaaattctggggatccactgctttggcgaacgcgccgccgaaattattcacatcggccaggcgatcatggagcagaaaggtggcggtaacactattgagtactttgttaacaccacctttaactacccgaccatggcggaagcctatcgggtagcggcgctgaacggcttaaaccgcctgttttaacaggcggtcaaagtggccatccatagtggtacggatggcctctgccagttgctcatagcggctgcgcagcggtgagccagggcggtagaccaggccaatggtacgacgcggttccggcttaatgcacggcagatagatgacgccgtcgcgcttgcgctctggcggtacagagagcgcaggcagcaacgtaataccacttcccgccgccaccatattacgcagcgtttccagactggtggcacggaagtgcgtatcttcgtcggccccggcttcgaagcaaaagcccatcgcctgatcgcgcaggcagtgcccgtcttccagcatcagcagtttttcgcctgcgagatcgcccatcggtacgcgatcgcggttcgcccacgggtgatcctcatagatcgccagcatcatcggctcgtcaaagagcggcacttcaataaaggcttcactctcttttaccagcgccaggatcgcgcaatcaagcttaccgctgtccagttgcgtcagcagctgatgcgtctgggcttcgtgcagatacatttccagtttcgggaaggtctggtgcaacagcgggataatctgcggcagcagatacggccccacggtcgggatcaggccgatatgcagcgggccggacatggtttcgccctgctggctggccatctctttaagcacttttacctcacgcagcacagtgcgcgcctgatccaccagcagcagaccggactgggtaaagagtactttgcggctggtgcgctccagaagcatgacgccaagctcatcttccagtttacggatctggccgctcagcgtaggctggctgacatggcaggcatctgccgcgcggcgaaagtggcggtgttcagctaacgcaaccaggtattcaagatcgcgaatattcattcttcatcctccgacgccatgatagtccatggcgatagatagaatagcaatgaacgattatccctatcaagcactctgtacaataattagcaacagaaacgaggcggcatctcaaaaatcccttgaagccactcgcctcgttttgaaaatactaaagccaacgtgaactatttagcggaccatgggtccgcttttttttgcagcaaataatgagtcctttacttataaatctacggataatccgtaaaacccgcctctaattataaattagataaatattatcccgccaatatatatatttagtttaagttaaaacgttattctcttgaaatatatttatgcctgcataaaaatgccgccgtagttttttcaataactgatggaatagtgaacgatgaaattgaatatgatgacgcgatattttatcgcggcaggtctattggcctgcgccggaaacgcctttgcgctggaagcatggagcggtcaggaaggcggcgatactattgaagtgatttttgacagtaaagtgtataccaaccgctggtatgttaacgctgataattgcccgaaagatgcatccgcagataactgggaaaatccatggacttatgtccgcgatgccacgcccgcagaaataaacgaatatggcaatccgaccacctgcgacgctggcggtatcacgccggtcaattacgacgcattcagcgccgaaaagaattacgtcacgggcgatattgtcagctatggcgatgtgaattatcaggcgaaaagcgcggttccggcatattcctttacgccaggcgaagataatccatggcaattatataccccagttccggtgtggagttctactcaggtatataacaaaggcgatgtcgcgcaacttgacggccagtcctatgaagcgctgttttacaccgtgggagataatccctcgaatcccgctaaccagaacccgaccggtactaatggccgtccatggaagccattaggcccgaccgtcgaatatagcgaagcagaactgagcgccgcgccacaatatagcgccactgcgctttatgaagcgggtacgctggtacagttccagggccagccctatgtatcgcaggcgaaagtgaaagccgtatcgccggttgatgaaaacccctgggcgatctacaccgactggaccggcactaaagagcgtgtaggtacgccgaaaaatccgtggcccgctcacgtttacgccccctatgtcgatttcaccctgaattccattccggatctggcgaagctggcgaaagagcaaaacattacccattacaccatggcgtttgtggtggcgaaaagcggcgagcagtgtatcccgacctggggcaccgcctacagcatgcaggactacgcccagtacagcaaaatcaaagcgctgcgtgaagcaggcggcgatgtgatggtgtctattggcggcgcgaacaactccccgctggcggcagcctgtaagaacgacgccgatctgcaaaaacactattacgacatcgtggataacctgaacctcaacgtgctggacttcgacattgaaggcacctgggtcgccgatcacgaatccatccagcgtcgtaaccgtgtggtgaaagccacccaggatcaatggaaaaaagagggccgtaaagtcggcgtctggtataccctgccgatcctgccgaccggtctgacgccggacggtgtctacgtgctggaaaatgcgcgtgatgcaggcgtggaactggcaggcatcaacgtgatgaccatggactacggcaactcaatttgtcagtccgacggcaccgaaggccagaacattcacggcacctgcgccacctccgccatcgacaacctgtttaatcagctgaagaaaatctggccggcgaaatctgataaagagatcaacgccatgatgggcaccacgccaatgattggctacaacgacgtgcagggcgaagtgttctatctgtcggatgcccaaaaagtcatgaaggatgctactgaccgtaagctcggtatgattggtatctggtcaatggcgcgcgacaagccaggcgtaccgggtcaggtttctccggaacatagcggcatgacgccatcgcaggcacccgagtacgcttacagtaaggtattcgcgcctttcaccagcgtctctgacgagctggctgacggcgtacactcttttgaagctgtcaccacggcaagccagcgtagcgttgaaatcaacctcactaccgccgcgcagaagagccgtaaatttgtcgctttccacaatgcaggtgaaggcgataaatacatgggtcatacccagaatggttcggtgtactacggcagtaaacgcgtcagcggcaacgacactatcgtcacgctgcattactactacgcaccaaaagtgggcgatgtcattaccctggtggaagatgtaaaaggtgaagtgactgtactgaagaaattcaccattacagaagagatgattaagctcaaataacccgctgtgctaaaaccagaaccccgccggtggcggggttcttttttgttcagcccaggcgttgtcgggcatcggcaatcgcctgcgctacctgcgccggagagacgccgcctttcgccgcacgtttatcgaggcaggattgcagtgacaggatcggatagacatcctcgccaattacgctgctgaatttctgtaaatccgccagcggcagatcttccagtggtttaccctgggcaatggcttccactaccgcttcgccgacaatatggtgcgcctcacggaagggaacgcctttggcgaccagataatccgccagctcggtggcattcgcgtaaccctgctgcgccgcttcctggcagcgtggacgtttcacctgaataccgtccagcaccagagttgccatgtgcaggcagtccagccaggtatccagcgcgtcgaacagcccttctttgtcttcctgcatatctttgttatacgccagcggcagacctttcagggtcatcatcatgccggtcagcgcgccctgtacacgcccgcatttaccgcggatcagctccagcgcatccgggtttttcttctgcggcattaaggaggagccggacgtcacgcgatcggacaactccacaaaacctgcttcaccggtgttgaagaagatcagatcttcggcgaaacgcgacagatgcaccatgccgatggacgcgtcagacagcaactccagcacgtggtcacgatccgatacgctgtcgaggctgttacgggtcgccgacgcaaagcccagccagcccgccagctgttcacggtcgatttcataagctgtacccgccagcgcgccgcagcctaacggactgacgtccagacgctttagcgcatcctgcaggcggctttcatcacgggcgagcatctcgacataagccagacaccagtgggcaaaggtcaccggttgcgcacgttgcaggtgcgtataacccggcatcaccgcatcctgattcgcctgcgcggtttccaccagcgcagactgtaactggcgattcgcgccaagcagttcactcacctgctctttacaccacagtttcagatcagtggccacctggtcgttacggctacgcccggtatgcaattttttgcccagcgcgcccactttgtcgatgagtctgccttccacccagctgtgaatatcttcggcgtcgctggtaagaatttgctgcggatcgagacgcacttcctccagcagaatagtgagcgcatcttccagctgttgctgttcctgcgccgtcagcacgcctaccgttactagcgccttagaccaggccacagagccaacaatatcctgctccgccaggcgatagtcaaagcgcaaagagtcgttgaactgtttgaaccgttgatccgctgcctgagtaaaacgcccgccccaaagtgccataacattcttcctttctttatgaattctgccggatggcgctacgcttatccggcctacggtctgtaggcccggcaagcaacgcgccgccgggcattaaatcttacgccagcgatgtatgaaatcttacgccagaatacgggtgccaatcggcgtgccgttaaacagcgccggaagttgttccgcatgacgccatgacgcgatgtccaccggacggcccagcgtgcgggcggcatccagcgcggcgttcaccttcacgatcatgccatcggtaataattccctggtcgatcagctgctcagctttcgccgccgtcatttcggcaatgcgctgacctttaccgtcaagaatgccgctgacgtcagacagcaggatcaaatccgcgcccagggtcgctgccagcgccgtggccgcctggtcggcgttgacgttcattaactgcccgtcgtcggtcacgccaatggagctgaccaccggcaggaaaccgccgtccagcagagtgttgataagctttggcgagccaggttttgcatggccgacgtgacccagttcttcgtcgagctgcgtcacgctcacgctgtcgccatcgcccagatacagaccaacggaggcgatatgatgtttcttcgcccatgccagcagcgttttgttggcggtccccgccagcgcgccggtgatgatgtcgatctgatcggctggcgtgacgcgcaggccgtttttcttggtcaccggcaggttaagctgcttcatcagctcatccaccacgcagccgccgccgtgcacgataaccagcgggcgctgatgagactcacgataattgaccagcgccgtaaacaggcgctccagcgcttcttcgctatccagcagtacgccacccagcttgataattaatggattcatcattgcacccttaaataagagactgcgtttcagcatagccgaaacgaatgtttgcacactgcaccgcctgcgccgccgcacctttcaacaggttatcttcggtcgccaccacaatgagatgctgatccgacaccgcgaaaccaatatcgcagaagggtaaaccgactacgtttttcagcgccggaacgcctttgtcatacagacgcaccagcggtttatccgcatacgcctgctggaaagcttgcgcgatctgcgcgctgtcgacgcccggtttcaggcggcaggtaatagtttccagaatgccgcgcgggaagttgcccaggtgcggggtaaagatcacctctgcgcccagatgggtggtgatttccgggtgatggcggtgattaaacacgccatagggttgcaggctcacttcacagaaactgttggagatagcggctttgcgcccggcgccgctgacgccgctggtggcgttgatcaccggccattgggaaagatccagcagcccggcgtcgatcaacggcttcagcgacagctgcgccgccgtcgggtagcagcccggcacggcgatcagattcgcctctttcagtttatcggcgttccactccgccaggccatagaccgctttttccagcagatccggatgctgatgggtgaagccataatatttttcatagaacccggcatcgttaacgcggaacgccccggagaggtcgaacaccacgcagcccgccgccagaaattgcggcgcgaggtcatggctgacttcatgggcggttgccagaaacaccacgtccacgccgtcggtaaattcgctgatgtcggacatcggctgtaaaggcagatcgacaatgcctttcagctgcggatgcaaatcggagatgcgctttcccgcatcattgctttgcgctgacacggtcaaagcggttatgttcatatgagggtggcgattcacgtagcttacaagctcagcgcccgcataaccgctagcgcccacaatcagcgtattcaacatcgggttcctttacgatcaacgttattgtatttttattcacatttactgcatgaatattgatactatcacgacctaaggtgtgtcaacaatgaaaatgaatctaccgccatttatcgagatttaccgcgctctgatagccacaccgtctatcagcgcaacggaagaagcgctggatcagagtaatgcggctttaatcaatctgctgggcggctggtttggcgatctcgggtttaaagtggacatccagccggttcccggcacgcgcaataaattcaatatgctcgccagcgcgggccagggatcgggcggtttactgcttaccggacataccgataccgtgccgtttgacgatggtcgctggacgcgggatccctttaccctcaccgagcatgacaacaaactttacggcctcggcactgccgatatgaaaggcttttttgccttcattcttgatgcgctgcgtgacgtggatgtgacgcaacttaaaaagccgctctacgtactggccaccgccgatgaagagaccagcatggcgggcgcgcgctatttcgccgaacacgccgaaatccgcccggactgcgccattatcggcgaaccgacatccctgcaaccggtacgcgcccacaaagggcacatctcgaatgccatccgcattcttggtcagtccggccactccagcgatccggcgcgcggcgttaacgccatcgaactgatgcatgaatccatcggtcatattctgcaactgcgcgacacgctgaaagaacgctatcactttgacgccttcaccgtaccttatccgacgctgaacctcggccacattcacggcggcgacgcggcgaaccgaatctgcgcctgttgtgaactgcatatggatattcgcccgctgccgggcatgacgcttaacgatctggaagggctgcttaatgaagcgctggcgccggtgagcgaacgctggccgggtcgcgtcaatatcgccgagctgcacccgccgatccccggctacgagtgcccgccggatcaccagctggtcgaggtggtggaaaaactgctcggcacgcaaacggaagtggtgaactactgcaccgaagcgccctttattcagaccctgtgcccgacgctggtgttaggccccggctcaattaatcaggcgcaccagccggatgaatatctggaaacgcgctttattaagccgacccgggagctgatcacccaggtggtgcatcacttctgctggcattaattcttccccctcgcctcccggtgaggggtgatttttgtcacatctccataagctttacttatctgcaactgcgcctgttaactttcataaattgccgtcatttattcgtttgctgaaccgttttcgcagcaattgacgcacggggttttacgtggctttataaaagacggtgtcttatttccctgcagtcctgatacgtgaccagggttataacaaaataaaatgagatggggtgtctgggttaacatgaacgaacaatattccgctttgcgtagtaatgtcagtatgctcggcaagctgctgggagataccatcaaggacgcgctgggagagaacattctcgaccgtgtcgaaacgatccgtaagctctcaaaatcctcacgtgcaggtaacgaagccgaccgccaggcgctgctcaccaccttgcagaacctgtccaacgatgagctgttaccggtggctcgcgccttcagccagttcctgaatctggctaataccgccgagcaataccacagcatatcgccaaaaggcgaaggggccagcaatccggaaattatcgcccgcaccctcagaaagctgaaagaccagcccgatctcaacgaagacaccattaaaaaagccgtggaatccctgtcgctggagctggtgctgaccgcccacccgacagaaatcacccgtcgcacgctgatccacaaaatggtggaagtgaataactgcttaaagcagcttgataacaaagacattgccgattacgagcgtaaccagctgatgcgccgcctgcgccagctgattgcccagtcctggcatacggacgaaatccgtaaacatcgcccaagcccggtggacgaagccaaatggggctttgccgtggtggaaaacagcctgtgggaaggcgtcccgaattacctgcgcgagctgaacgaacagctggaagaaaatcttggctacaagctgccggtggattttgtcccggtgcgtttcacttcctggatggggggcgatcgcgacggcaacccgaacgtcacggcggagatcacccgccacgtcctgctgctgagccgctggaaagccaccgatctgttcctgaaagatattcaggtgctgatctctgaactgtcgatggtggagtgtaccgacgaactgcgtgaaatggtcggcagcgaaggcgcgcaggagccgtaccgctatctgctgaaagggctgcgcagccagttgatggcgactcaggcctggctggaagcccgtctgaaaggccagcgcctgccaaaaccggcaggtctgctgtccaataacgaacagctgtgggatccgctgtacgcctgctataaatcgttgcaggcctgcggcatgtcgatcatcgctaacggcgaactgctcgataccctacgccgcgtcaaatgctttggcgtaccgctggtgcgtattgatgtgcgtcaggaaagcacccgccataccgaagcgctgggcgaactgacccgctacctcggtatcggtgattacgaaagctggtcagaggccgataaacaggcgttcctgatccgcgaactcaattccaaacgtccgctgctgccgcgcaactgggagccaagcgatgacacccgtgaagtatttaacacctgcaaagcgatcgtcgatgcgccgcaaggatccgttgccgcctatgtgatctcgatggcgaaaacgccgtctgacgtgctggccgtgcatttgctgctcaaagaagcgggtatcggctttgctctgccggtcgcgccgctgtttgaaaccctcgacgacctcaacaacgccaatgacgtcatgacccagttgctgaatatcgactggtatcgcggcttcattcagggcaaacagatggtgatgattggctattccgactccgcgaaagatgcgggcgtgatggcggcctcctgggcgcaatatcaggcacaggacgcgctgatcaaaacctgcgaaaaagcgggcatcgcgctgacgctgttccacggacgcggcggctccattggtcgcggcggcgcaccggcgcacgcggcattgctttctcaaccgccgggcagcctgaaaggcggactacgcgtgaccgaacagggggagatgatccgctttaagtacggcctgccggatatcaccatcagcagcctgtcgctctacactggcgcaatcctcgaagccaacctgctgccgccgccggagccgaaagacgcctggtgccacattatggacgagctgtctgacatctcctgcgacatgtaccgtggctatgtgcgcgaaaacgaaagctttgtgccctatttccgttcggcgacgccggagcaggaactcggcaaactgccgctgggctcacgtccggccaaacgtcgcccgaccggcggcgtcgaatcgctgcgcgccattccgtggatttttgcctggacgcaaaaccgcttaatgctgcccgcctggctgggcgcaggcgcggcgctgcaaaaagtggtggaagacggtaagcagagcgaactggaagccatgtgtcgcgactggccgttcttctctacccgtctggggatgctggaaatggtgttctccaaagctgatttgtggctggcggaatactacgatcagcgtctggtgaaaccggaactgtgggcgctgggcagcgaactgcgcgaccaactggaagcggacatcaaagtggtgctggatatcgccaacgactcgcacctgatggccgacctgccgtggatcgccgagtccatccagttacgtaacatctataccgacccgctcaacgttctccaggccgaactgctgcaccgttcgcgtcaggcggaagaagaaggtaaagaagcagatccgtgcgtggaacaggccttaatggtcaccatcgccggtgtggctgccggtatgcgtaacaccggctaatctgcacggcctcccccgcccggtgacgcaacgttcaccgggcgatctccgggaaaaacatgtcatacgacctcagccatcaccttacccgattcgccgaagacgccgccctgttgcagcgcgtctggtttgctcgcggcgcagggccggttccggcaggggcattacagacggattttccgcggctggaaatcgtgctcgagggcgaaataacagacggtagtgaacccgctgtcatggcggaaaacgacgtgctctttatccccaccggtcactggaatgcgccgcagtgccgccagcccgccactctgcttaacatccactttgagaaacagtatttagttttcagcgtgcaacgccgggacggcgtccatctgcacaatctgtgtcacgcccaggtggcgcggcgcggcccgcgtaccggctctttattattgcagacgctcagtgaattacagatgcagccgcacgagcagcgcaccgcccgtctcacggtaagaagcctgctcagccactgcgccgatctgctgggcagccagatccagaccgcctcccgcagccaggcgctgtttgaagccatacgccattatatcgacgaaaattatgccgcgccgctgacccgtgagtccgtggcgcaggcgttctatatttccccgaactacctctcccatctgtttgccaataccggggcgacaggatttaacgcttatctgaaccagatccggctggaacatgcacgcatgttgctgaaaaattacgatctgaaaataaacgaagtggcccacgcctgcggctttgttgacagtaactatttctgccgcctgttccgcaaagccaccgagcgcaccccgtccgaataccgccgccagtatcacagccagctgaccaaaacgaacctgtgagccagctcgcatttctgaccgcagcttacatttgtccagtgtttggcagatttgacagatagcggcctgtcggccccggcttttatgctgatcgccatcgcaacttcagaaagctgacgaggtaaagcatggaactctatctggacacggccaacgttgccgaagtcgaacgcctggcgcgcatttatccgctggcgggcgtgaccaccaacccgagcataatcgccgccggtaaacagccgctgcgggaggtgttaccgcgtctgcaacaggctatcgggcctgacggcacgctgttcgcgcaggtgatgagccgcacggcggacggcatggtggcagatgcccgacagctgaatgacatcctgccgggcatcattgtcaaagtgccggtgactgccgaagggctggcggccatcaaaatgttaaaaaaagaaggcatcgtgacgctgggaacggcggtgtacagcccggcgcagggtctgctggcggcgctcgcgggggcaaaatacgtcgcgccctacgtcaaccgcgtggatgcgcagggcggcgacggtatccgtatggtgcaggagctgcaacgtctgctcgaacttcatacgccggacagcatggtgctggcagccagctttaagaccccgcgccaggcgctcgactgtctgctgaccggatgtcaggcgattacgctacccttagaggtagcgcaacaaatactcggtacgccggcagtagaggcggcgatcgagaaattcgagcacgactggcaaaccgcctttggcacgttaacgctgtaaaaggagtcaactatggaccacattattcaatcgccgggcaaatacattcagggggcagatgtgctcacccgtctgggagactatctgaaaccgctggcggaaagctggctggtggtcggtgacaaattcgttttaggtttcgcgcaggagacgctgcaaaaaagttttgatgatgccgacctgagcgccgatatcgtgccctttggcggcgaatgttcgcaaacggaaatcgaccgtctgcgcgcgctggctgaagaggcagactgcacggcggtgctgggcattggcggcggtaaaaccctggataccgccaaagcgctggcccactacatgcacctgccggtggcgatcgcgccgaccatcgcctcaaccgatgcgccgtgcagcgcgctgtcggtgatctataccgactccggtgaattcgaacgttacctgatgctgccgaaaaacccggatctggtgattgtcgataccaaagtggtggcgggcgcgcctgcgcgtctgctggccgccgggatcggcgatgcgctggccacctggtttgaagcgcgcgcctgcgcccgcagcggggccaccaccatggcgggcggacagtgcacccaggcggcgcttgcgctggccgagctgtgctacaacacgctgctggaacagggtgaaaaagccatgctggcggcggagcagcatgtggtgaccgccgcgctggagcgcatcgtggaagccaatacctatctcagcggcgtcggctttgaaagcggcggactggcggcggcgcatgccattcataatggtctgacggcgatcccggacgcgcaccattactatcacggcgaaaaagtggccttcggtacactgacgcagctggtgttagaaaacgcgtcggtggaggagatcgaaaccgtggcgtcgctgtgtcacagcgtcggcctgccgatcaccctcgcccagctggatattaaagccgatattccggcgaaattgcgccaggtggcgcaagcggcctgcgcggaaggggaaactattcacaatatgccgggcggcgccacgcctgatgaggtgtacgcggcgctgatcgtcgccgatcagtatggtcagcgtttcctggaagagtgggaataaaccggttgccgggcagtcatgcccggcgtttttggttacagcgacgggcgcacgcccagcgtatgacaaatggcatagctcatctcggcgcggttcagcgtatagaagtggaaatccttcaccccttcgcggcttaaaatcttcaccatgtccatggcgatattcgcgcccaccagcttacgggtttcggggtcatcatccagaccgttaaacatctgcgacatccatgccggaatacgcacgttggtcatgtcggcgaattttttagcctgtttaaagttcgagaccggcagaatgcccggaatgatttccacgtcgatgccggtcgaggcgcagcggtcgcggaatcgcagatagctttccacgtcgaagaaaaactgcgtgatggcacggttagcgccagcgtcgattttgcgtttcaggttcagcagatccgcctgcgcgctcttcgcttccgggtgcacttccggataggcggcaacggaaatatcaaaatcagcaacctcttttaacagcgcgaccaggtcggtggcgtacatatccggtttaccgccgcccggcggcagatcgccgcgcagcgccacgatatgacggataccgttgttccagtaatcccgggcgatgctgcgcagttcgtcacggctggcgtcaatacaggtgagatgcggggccgcttccagaccggttttatctttgatgcctttaataatgctgtgcgtacggtcgcgctcgccggagtttgcgccataagtcacggagacaaatttcggcttcaggctgctcaggcgatcgatggagtgccataaagtctgttccatttcactggtgcgcggcgggaaaaactcaaaagagacattaatctgcccctgcacttctgccaggctctgattcagggcttcccgctggttggcgtgaaaaaagctcataccttacctcatcaatcgcgtgtcgttgtttattgtaatgtgaacttctatacgtttagacgtccagatgtaaaaatgacggaaaagcgatatggcgtcaacagaattatcgtgaaactgtgtgaggattgttcagggaagatgaaaaagattcaggatggaaagccccctcactctggcagtgagggggataaaaactacagcagttgcgccaggcgattgatgtctgactggatcgccccggcggtcacatcgcgtcccgcgccaggcccgcggatcaccagcggattatcgcgataccagcggctttcgatggcaaacacgttatcgcacggcagcagggccgccagcggatgttcagggcgtaccgcttccacgccgacgcgcgcttttccgttagcgttgaaacgcgccacgtaacgcagcacgaggcccatttcccgcgccgcttccagccgctgcaccatctggtcgttcagctcatcgccgttctcaaagaagtgatccaccgacccctcttcacagccgttcggcaccagcgactccacgcgcacctgatccggttcgatgtcataacccgcttcacgggcaaggatcaccagcttgcgcatcacgtctttaccggagagatcgacgcgcggatccggctcggtcagcccctgctgccaggcctgatccaccagctcggtaaagggtacggtgccgtcaaattgcaggaacagccaggagagcgtgccggagaaaataccgctgatagcgagaatggcatcgccgctgtcgatcagatcgcgcacggtatggttcacgggtaagcccgcgcccacggtggcgttatacagccagtgacggccggttttttcgaaggcgtcatggatctggcggtatttgtgactgtcgctcgctccggccagtttattggcgctgataacgtgaaaaccgtggctggcgaagtccagatactgatcggccagctgttcgctggcagtcacatccagcaccactaaatcatcatagggatgggcgcgcatccacaggaacagcgactcctcatcctgttcgaccgcttcatcgttaaagaacgccagcgcgcggctggcatccagcccctcatagctcagcaggctgcggcggctgtccaccacgcccgccagcacaaattcaaaaccggtccgcgccgacagcgcgccctgttcacgggcgaacagctccagccagcgcgagccgatattgcccttgccgaacagcatcagaccgatacgtttttccgcgcggaacagcgactggtgcagcccctggatcaggctctccgtcggcccggcgcgcagcacggccaccaggctgatgctgtcgtcggactgccagataaactctaccggctgaccctttaattgctgccagaaacgatggctgtgcagcggattacggcagacgcccgccccgaccagcgccaccagcgccagcccctgacgcaggcgcagttcaccggtcagcccggcgtcctgcaacagcttcagcgcgctgtcgaccacttccgaggtgtagcaaagttgcagcaggttgcgatcgttatgaatgccgaccgccagcggacgcagctgcgcgcgcttgaggatcagatccacctctttatgggccagcgcgaaatcctgactggcgggcacctggaactcaatcaggcagacgtcatcatgactggtgacaatacgcgccccggtgccggatgccagcacgcgctcaatgcgcgtggagccctgctccgggttgtagctgcaacgcagttgcagatcgatgtcgctggcggaaaccggttgtaaggtacgggcgtgcagcaccggcgcggccagacgcgccagttcgctggcttcatcaaggcgcagcagcggcagcaggcaggcatcttttactttacgcgggtcggcgctgtacaccccggccacgtcgctccagatggtcacgcgggacacgccgcccagcgcgccgatttgcgtcgccgagtagtcggaaccgttacggcccagcagcacggtttcccccgcatcgttgcggcagataaagcccgtcaccacggtacgtttattgggatgctgcgccagcagttgctgcaacagcggataggataagccttcattgacctgcggttgcgggccgcgctcggcgcgcaggaagtcgcgcgcatccagccaggcggattccataccctgtaaattgagcaccgcagacatcaggcgcgccgaccagatctcaccgtgccccaccacttccgcatacaccgcgtcggtgatgccgctgtcaagcagcgccgccagtcgctccagatcgtgaataaacgcctgggtgagcgtgtcggccatatccgcaggcagcagaccgccgatcagatcgctttgatagcgacgcagcgcctgttgaacctgatgcgcagagagcctgtcggtctggcttaacttcagccagctgatcaactggttggtggtgctgcccgccgccgagacgaccatcatgtcgccaggctgcgaatattccgccatgatacccgccacacgcaggtaacatttcacgtcagccagactactcccaccaaacttatgcagttgacgacctttcgcccctgcctgcgcaatcacactcatgtttaccccttgtttgctgcccggaagccattttccaggtcggcaattaaatcttcgccatcttcgatgccggtggaaatacgcagcaacgtctcggaaatacccgccgcggcgcgcgcttctggcgccatgcctgcgtgtgtcatggtggcggcgtgggagatcaaactttcaactccccctaacgactccgccagcgtaaacagtgacagcccgcttaagaaacgacgtaatgtttgttcatcgccatccagttcaaaactgagcatggcgccaaatcctttttgctgacgggcagcaatctcgtggccctgattttccggcaacgacgggtgatacagttttttcaccagcggctgtgttttaaggaaatccacaatcccctgggcattgcgttgcgccacttccatgcgcggcgacaacgtacgcagcccgcgcagcagcagatagctgtcaaaggcgctgccggtgacgccgatattattcgcccaccatgccagttcagtgacagtcgcctcgtctttggcgatcaccacccctgcgaccacgtcagaatggccattcagatatttagtgcatgaatgtaaaaccagatcggcacccagcgccagcgggttctgcaatgccgggcttaagaaggtgttatccaccacgctgacggccccggcttcacgcgcaagctgacagattttcgcaatatccacaacgcgcaacaatgggttgctcggactttccaccagcaccagtttcggtttttcggccagcgccgattttaatgcctgctcgtcgccctgatcgacaaataaaacgcgataacagccgcgttttgccagactgtcgaacaggcggtagctgccgccgtagcaatcgtgcggcgcgaccagcagatcgccgggcttcagaaagacagtggtcaccaggtggatcgccgacatgccggtattggtcatcaccgcgcccgcgccgccttccagttccgccagcgcgcgctgcaccacatcccgcgtcgggttaccgcgacgggagtagtcatgggctcgcggttcgttaaagccggtgaagttataggtactggagagatgaatcggcgggacaacgcaaccgtactgctcgtcatcattcaatccgctacgcactgcgatggtggcctgtttacgcgtcatgtgaaggcttcctggcttaagggatgaaaagtcagccatcagaatagcattgtgaatatggacgtcaatacatctggacatctaaacttctttgcgtatagattgagcaaatgcataatagccgttaaaattatatgcgttagcgcatatccgccgattcgatactccgtgtcacggtgtcgtctctacggtaaactacgcgagattacggtgcggtacctgcgtttgatcaggtttcgaccttttactaatgactgagaggattaaaggtatctcatggctgaatggagcggcgaatatatcagcccatacgctgagcacggtaagaagagtgaacaagtaaagaaaattacggtttccattcctctgaaggtgttaaaaatcctcaccgatgaacgtactcgtcgtcaggtgaacaacctgcgtcacgccactaacagtgaactgctgtgtgaagcgttcctgcatgcctttaccggtcagcctttgccgaacgatgaagacctgcgtaaagagcgcagcgatgagatcccggaagcggcgaagatcatcatgcgtgaactgggcatcgacccggatacgtgggaatactaagcaataaaaaagggcagaagatattctgcccttttgttttggcccgaatttcaggcataaaaaaaccgcccgcaggcggttctttctggcagccaatacttatttgctgctgcctggcaggctgaagcgcttgttgaagcggtcaacacggccaccggtagcaacgtcacgctgcttgccagtatagaacgggtggcatttgctgcacacgtccaggttcagatcgtgacccacggtagaacgggttttgatcacattaccgcaagaacagtttgcagtaatttcaacataattcgggtgaataccttttttcatgggagaaacctcagtttaaggccgcgtcgctcttccagccctaacgccagacaccacgcgatgtttaaagtagttacgttctctttgacgtgatcaaaacacatcaaaggcggcgaatcatacagaaaataaccagcgcatgcaaactgatccgcgccttctctttctaatgtgtatactaacccgccagttttcaagccaggatgattcgatgcccgtcgctcacgtagccctgcccgtcccgctgccccgtacgtttgactaccgcctgccggaaggcgtcgccgtcaacgcgggctgtcgcgtgcgcgtgccctttggtaaacaggagcgggtcggcattgtggtgtccgtcagcgagacaagcgaactgccgctggatgagctgaaaagcgtcgtcgaggtgctggataacgatcccgtgttctccccgtctgtatggcgattactgctgtgggccgctgattattaccatcatccgctcggagatgtgctgtttcacgctttgccggttttgctgcggcagggcaagcccgccagcgttgcgcctctgtggttctggttcgccaccgaacagggccaggcggtagacatcaacagtctgaaacgctcgccaaaacagcagcaggcgctggcggcgctgcgccagggaaaaatctggcggcatcaggtgcaggatctggaatttaacgatgcggccctgcaggcgttgcgcgccaaaggcctgtgcgatctcaacagcgaagccccggcgctgaccgactggcgggaaaattacgccgtacccggcgagcggctgcgtctgaataccgagcaggctaccgccgtgggcgccatccacagcgaatctgacaccttttccacctggctgctggcgggcgtcaccggctccggtaaaaccgaagtctatttaagcgtgctggaaaatgttctcgctaagggaaaacaggcgctggtgatggtgccggaaatcggcctgacgccgcagaccattgcccgctttcgcgaacgttttatcgcgccggtggaagtgctgcactccggccttaacgacagcgaacgcctgagcgcctggctgaaagcgaaaaacggcgaagcggcgattgttatcggcacgcgttcgtcgctgttcactccgttcaaaaatctcggcgtgattgttatcgacgaggagcacgacagctcctataaacagcaggaaggctggcgttatcatgcccgcgacctggcagtctaccgcgcccacagcgagcaaatcccgattattttaggctcggccaccccggcgctggaaacattacataatgtacggcagcgcaaataccgtatgctgcgcctgacgcgccgggccggtaatgcgcgcccggccacgcagcatgtgctggatttaaaaggccagccgctacaggcaggactggctccggcgctgatcgcccgtatccgccagcatgtgcaggcggataatcaggtgatcctgttcctgaaccgccgtggctttgcgcctgcgctgctgtgccatgattgcggctggacggcggagtgcccgcgctgcgatcactactacaccctgcaccaggcgcagcgccatttgcgctgccaccactgcgacagccagcgcccggtgccgcgccagtgtccgtcctgcggctccacgcatatggtgccggtgggtctgggcaccgagcagttagagcaggctctagcccccttctttcccggcgtgcccctgtcgcgtatcgaccgcgataccaccagccgaaaaggcgcgctggagcagcagctggcggaagtgcatcgcggcggcgcgcggattttaatcggcacgcagatgctggcgaaaggccaccatttcccggacgtgacgctggtggccttgctggacgttgacggcgcgctgttttccgccgattttcgcgccgccgagcgcttcgcccagctctatacccaggtttcaggccgtgccggtcgcgccggcaagcagggcgaagtggtgctgcaaacgcaccatccggaacatcctttattacagacgctgctgcataaaggctacgacgcctttgcggatcaggcgctggccgagcggcatacgctgcaattgccgccgtggaccagccatgtgattattcgtgccgaagatcataacaacgagcaggcgccggttttcctgcaacagctgcgcaatctgttgcacgccagcccgctgctggacaacaacacctggattttagggccggtgcccgcccttgcgccaaagcgcggcggtcgctaccgctggcaactgctgttgcagcatccgtcacgcgttcgcctgcaacatcttatcagcggcgcgctggtgctcatcaatacccttccggaagcgcgcaaggtgaagtgggtgctggatgtcgatcctatcgaaggttaaggttgcgaggcggatcgtataattcaacatccgtcacacttttcatgaaaatactgtaaccggaacgggtaactatctgataaaaatgtgtctgatgtcagacacagaggatgtggctgcgcctgcgtctggatgcgaggagaaagaggtgaaggctaagaaagaggttgctgccgcgaccatgaaagacgttgccgagaaagcgaaagtctctacggcaacggtgtcccgcgcgttaatgaacccggataaagtctcgcagtcgacccgcaaccgggtggaacaggcggcccttgaagtgggctattatccgcaggcgatggggcgcaacgtgaagcgcaatgaatcgcgcactatcctggtgatcgtgccggacatctgcgatccattttttagcgaaatcatccgcggtattgaagtcacagcggcggaacagggttatctggtgctgatcggcgactgcgcccatcagaatcaacaggaaaaaacctttatcgacctgatcattaccaagcagatcgacggtatgctgctgctcggctcgcgcctgccgtttgacgccagcatcgaagaacagcgtaatttaccgccgatggtgatggcgaacgaattcgcccctgaactggaattgcctaccgtgcacatcgataacctgacggccgcttttaatgccgttaattatctgcgcgaacagggccatcagttgatcggctgtatcgccgggccggaggagatgccactgtgccattatcggctacagggctatgtgcaggcgctgcgccgcaccgggatcaccgttgatccgcactatattgcccgcggcaattttacctttgacgcaggcagcgcggcgatggagcaactgctggcgctaccgaagccgccgaccgccgtattctgtcacagcgatgtgatggcgctgggcgcgttatcctgtgcgaaacgtcatggcctgaaaattcctgacgatctgtctattattggtttcgacaatatctcgctctcccagttttgcgatccgccgctgaccacagtgtcgcaaccgcgcttcaaaatcggacgtgaagcgatgctgcttttactggatcagcttcacgggcaaaacgtcagcagcggttcgcggctgctggactgcgagttaatcatccgtgggacgacacaagccgttacctgaagtaataggctttaagactcccgcttctggtcaaagccccgtcgcttaagtaacatgacgggctgacaaacgaataaatacagcgaaacgatagtggcacaacgagattatgtacgccgcagccagtcggctccttcgcggcgaaaaaagagcacgtcaaagaaaaaacaacgtagcccgtctgttgtatcgcccgccatggttgccattgcggccgctgtgctggtggcgtttatcggtggtctgtactttattacgcaccataaaaaagaagatgcagagacgctgcaaaatcagaaggttgcagggaacggactgccgccaaaaccggaagagcgctggcgctatatcaaagagctggaaagccgtcagcctggcgtacgcgcgccgacagagccgtctgccggtggcgaggtgatgaacccgagccagctgacggacgagcagcgccagttgctggagcagatgcaggcggatatgcgtcagcagccgactcagcttaatgaagtgccctggaacgaacagacggcggaacagcgtcagcaaaccctgcaacgccagcgtcaggcgcagcagcaggttcagctacgccagcagcaacagcaacagcagacatacacgcagccggtgcagcagccgagaacgcagccccgggtaacggaacagccgtatcagcaaccgcgcacggtgcaaaccgcgcccgcgcagactaagccggtacagcagcagccgaagcagaccgcttcccagcagccttatcaggatctgctgcaaacgcctgcgcataccgatgccgcgccgccaaaacagcaggccgcgccgatcacgcgtgagccggaagcgccgaagaaaacggcagagaaaaaagatgagcgtcgctggatggtgcagtgcggttcctttaaaggcacagagcaggcggaaaccgtgcgcgcgcagctggcgtttgaaggcttcgactcccgcatcaccaccaataacggctggaatcgcgtggtcatcgggccgatcaaaggcaaagataataccgacggcactcttaaccgcctgaagatggcgggccactcaaactgtattcgtctcgcctccgggggttgaaacccccaaaatcccccccatctataattgcattcagccccgtacactgtgcggggcttctaatccgtttatgcaacaaggggtctgctcgtgacaacaatcgtaagtgtacgccgtaacggccaggtggtaattgctggcgacggccaggccacgctgggcaacaccgtaatgaaaggcaacgtgaaaaaagtgcgtcgtctgtacaacgacaaagtaatcgccggttttgcaggcggtactgccgatgccttcacgctgtttgaactgtttgaacgcaagctggaaatgcaccagggtcatctggtgaaagccgccgttgagctggcaaaagactggcgcaccgaccgcatgctgcgcaagcttgaggctttgctggccgtggcggatgaaaatgcgtcgctgatcatcaccggtaatggcgatgtggtgcagccggaaaacgatctgatcgctatcggatccggtgggccgtacgcccaggccgccgcccgcgcactgctggaaaataccgacctcagcgcgcgcgacattgctgagaaggcgttgggcattgcaggcgatatctgcatctacaccaaccacttccataccatcgaagaattgtcctctaaggcgtaaggatctctaatgtctgaaatgaccccacgcgaaattgtcagcgaactgaataaacacatcattggtcaggataacgccaagcgttccgtggccattgccctgcgtaaccgctggcgtcgtatgcagctcgacgaagagctgcgccatgaagttaccccgaaaaatattctgatgattggcccgaccggcgtcggtaaaaccgaaatcgcccgtcgtctggcgaagctggcgaacgcgcctttcatcaaagtggaagcgaccaaattcaccgaagtgggctatgtgggtaaagaagtggattctatcatccgcgatctgaccgatgccgctatcaagatggtgcgcagcaactccattgaaaaacaccgctaccgcgcggaagaaatggcggaagagcgcattctggacgtgctgatcccaccggcgaaaaacaactggggccagcctgaacagcagcaggagccgtccgccgcgcgccagtccttccgcaaaaagctgcgtgaaggcgagctggacgacaaagagatcgaaatcaatctctctgccgcaccgatgggcgttgaaatcatggcccctccgggcatggaagagatgactagccagttgcagtccatgttccagaacctgggcgggcagaagcagaaaccgcgtaagctgaaaatcaaagaagcgatgaagctgctgattgaagaagaagcggcgaagctggtgaacccggaagagctgaagcaggacgccattgatgctgttgagcagcacggcatcgtgtttatcgatgagatcgataaaatctgtaagcgcggcgaatccaacggcccggacgtttcccgcgaaggcgtgcagcgcgatctgctgccgctggtggaaggctgtaccgtctccacgaaacacggcatggtgaagactgaccacattctgtttatcgcctctggcgcgttccaggtggcgaagccgtcggatctgatcccggaactgcagggtcgtctgccgatccgcgtggaactccaggcgctgaccacggaagatttcgaacgtatcctgactgagccaaacgcgtccgttaccgtgcagtacaaagcgctgatggccaccgaaggcgtgaacatcgacttcaccgaagatggtatcaagcgcatcgcgcaggccgcctggcaggtgaacgaaaccacggaaaacatcggtgcccgccgtctgcatactgtgctggagcgtctgatggaagatatctcctatgacgccagcgatcgcaatggtgaatccatcactattgatgcggcttatgtgagcaaacacctggatgagctggttgcagatgaagatttgagccgttttatcttataatcgcgcgcactgcactttcatcactgttgatggggctgaatagccccatttttattggctaaaaactatgactgactcgcgccctttaagccgcacccaggcctggctggaaagcctgcgtccgaaaactcttcctctggccttcgccgcgattgtggtcggcacaacgctggcctggtggcaggggcattttgatcccctcgtcgccgtgctggcgctgatcaccgccggtctgctgcaaatcctctccaatctggcgaacgattacggcgatgcggtaaaaggcagcgataagcccgaccgtatcgggccgctgcgtggtatgcaaaagggcgcgatcacccaggcgcagatgaagcgggcgctgatcgtaacagttatcctgagcgcgctgtccggactggcgctggtcgccgtggcctaccagacgctggcggattttgtcggcttcctggtgctgggcgggctgtcgattatcgccgccatcacctataccgtcgggcgtcgtccctatggctacattgggctgggcgatatttccgtgctgctgttctttggctggctgagcgtgatgggaagctggtatttacaggcgcacacgctgatcccggcgctgttcctgcctgccacggcctgcggcctgctgtccaccgcggtgctgaacatcaataatctgcgcgatattaacagcgatcgtaccaacggtaaggacacgctggtggtgcgtctggggccggtgaatgcccgccgttatcacgcctgcctgctggcgggcgcgtggctgtgcttcgccctgttcaacctgatttcactgcaaagtctgtggggctggctgttcgtgctcgccacgcccgtgctggtaaaacaggcgcgctatgtactgcgtgaaaccgaagcgagcgcgatgccgccgatgcttgaacgcaccgtaaaagccgcgcttttaactaacctgttgtttgtagtcggtatagtgctaagtcagctggcggtttaactgacaaatatcaattaacaattgatgattttgccaacaacgcgttatgcacgatatactgacaactctcgcggcaactgaacgtaaatcctatgaaatatgatacttctgagctttgtgacatctaccaggaagatgtcaacgtcgtggaaccgctgttctccaactttggtggacggtcgtcttttggcggacaaatcatcacggtcaaatgtttcgaggacaacgggttgctctatgatctgctcgaacagaatggtcgtggacgcgttttgctgatcgatggcggcggttcggtacgtcgtgcattaattgatgcagaactgggacgcctggccctgcaaaacgaatgggaaggcattgtggtctatggcgcagtacgccaggtagacgatctcgaagagctggacatcggcattcaggccattgccgctattccggtaggcgcaaccgcagaagggattggcgaaagcgacatccgcgttaattttggcggcgtgactttcttctccggcgaccatctctacgccgataacaccggcattatcctttccgaagatcccctggatatcgagtaaataaaaaaggccatcgttacgaccgatggcctttaatttcaggtgttatcattcgtctcatagtaaacgatacgtaattcatatttcccatcggatgatgtagtaaagacactcatgatggcattatcatcgtaataattatctataaagttctcgagttgttctaacctcacatcaatttcaggttttgggatctctttaaaaataagctcgcttttttgaagaccatttacttcctgtgcatgcacaataaagtaccatttatctgttacgcgtggtgctttctttaatggttctggcgtcaataagagatagcgaaagtaatcctgttgtgtatattcttcatctgaaaatactcttgtcattgaatagcaataaaaaagtgcaagtgatactatgaaaaaaacagctaatatcaacctgagttttttcatcagaaaatctctcttatccactctgggtttgccacaggctttattgtattcataaatgctggtaagtgtcccggataaggctgatgctttactttcttatctataggatccgggaaaatgagaggaagtacacttttgtttttaaattcccccacggggccatagtagtcccagatacgataagctttctctttagggcaaatatcaagcaatggagtgtaatccgtacaatctacagcctgatagaaaccaaaaagatttgagaccaggtcctcagcgctaaaaccgctatctgttaccagaacatagggccaaaaatcttgtaaggtttcaaattggcgggaagtacccatgaatatcgatagcgccactcctttcaaatcgcgatcattcaatcctctgcgtactaaaaatcgtctatatatacccgtgacagcatttataccatagatgctttttttcatatcctgataatagttgacttcaaagtattgattattaccaccacgtggcattgccatttgatgccagagtctttctgcaccagaggggtttgcatgtcctaaatcaatccaacctaagttttctgtatagattaaccccgacctaatttccctcgtaatatatcgatccatattatcaataatgtcagctctctttgtcatttcacattccttgagaaattaaagagttcatactactactttagaaataaaaaaagcatccaaaggatgctttttttagtgaagataaatcagacttcttccatgcggcctaataaagcctgcagacgatcctgccagccggactgctgttctctcagttcgtggttctcacgctccagctgctcgcgggagtgctgtgcggactgcatttcctgtgacagcgagttgttcttttctttcagctcttcgatttccatctgcagcagggtgatggtatcaatcgcctgctgtactttcgcttccagcttctcaaacacttctaatgacatagtcatacctctcctgaattccgatttgcaaggcgacgcccgtttcaacgcgcactctatccccccgattgtatggagcgaccacgcgcctgtccagcgacaacccttgtagatcgcgctttgcaacacttttaagcatatacctggtgcgtttggcgaaactacccctaaattgttaacgcattcgttaatgaaatgattcagctcacttttcgagctgctgttaaaacgcgctttatagcgcgaaaacgctcattttattgacggagtacacacattttgatttcgatatttctcgtttttgctcgttaacgataaattaacaccgtgtctacagggcatcgtgactgtcattgagtcgcgctaacaataaccattacactcttcaggatccgattatgagtcaaacatcaaccttgaaaggccagtgcatcgccgaatttctcggaaccgggttgttgattttcttcggtgtcggatgtgtcgcagcgctgaaagtggcaggcgccacttttggacagtgggaaatcagtattatctggggtctgggcgtggcgatggccatctacctgaccgcaggggtttccggggcacatcttaatccggcggtaaccattgcgttatggcgatttgcctgtttcgacgggcgtaaagttgtaccatttatcgtttctcaatttgccggcgcgttttgcgcagcggcgatcgtttacgggctttattacaatcttttcatcgactttgagcaatcgcatcagatggtgcgcggtagcgtcgaaagtctggatctggcaggtatcttctcaacttatccgaatccgcatatcaattttgtgcaggccttcgcggttgaaatggtgattaccgctattctgatgggcgtgatcatggcgctgggcgacgatggcaacggcattccgcgcggcccgctggctccgctgttaatcggcctgctcatcgcggtgattggggcatccatggggccgctgaccggctttgcgatgaacccggcgcgtgatcttggtcctaaaaccttcgcctggcttgccggctggggtgacgttgccttcaccggcggcaaagatattccttacttcctggtgccgctgtttgggccgatcgtgggcgcgtctctgggtgcgtttggctatcgtaagctgattggccgccacctgccctgcgatacctgcgtagtggaagatgagaaggctccggccagcgccactgcacaacaaaaagcttcgctgtaatgtgactacgggacaaaattatgactgacaaaaaatatatcgttgcggttgaccagggaaccaccagctcccgtgccgttgtaatggatcacgacgccaatatcatcagtgtcgcgcagcgcgaattcgaacaaatttatccaaagccaggctgggttgaacatgacccgatggaaatctgggcgagccagagttcaacgctggtggaagtgctggcgaaagctgacatcaacgccgatcaggtggccgccattggtatcaccaaccagcgcgaaaccgctatcgtatgggataaagagaccggcaagccgatttacaacgccatcgtctggcagtgccgtcgtacttccgacatctgtgagcatttaaaacgtgatggcctggaagattacgtgcgtaaaaccaccggtctggtgatcgacccgtacttctccgggaccaaagtgaagtggatccttgaccacgtggaaggctcccgcgagcgtgctaagcgcggcgaactgctgttcggcaccgtcgatacctggcttatctggaaaatgacccaggggcgcgtgcacgttacggattacaccaacgcctcccgtaccatgctgttcaacatccacacgctggaatgggacgccaaaatgctggaagtgctggatattccgcgggaaatgctgccggaagtccgcaaatcttcagaagtgtacggccagaccaacgtcggcggtaaaggcggcacccgtattcctatcgccggtatcgccggtgaccagcaggcggcgctgttcggccagttgtgcgttaaagaagggatggcgaaaaacacctacggcaccggctgctttatgctgatgaacacaggcgaaaaagcggtggcgtccgagcacggtctactgaccaccatcgcctgcggtccgcacggcgaagtgaactatgcgctggaaggcgcagtgtttatggcaggtgcatccatccagtggctgcgtgatgaagtgaagctgatcagcgatgctttcgattccgaatacttcgccaccaaagtgaaggataccaacggcgtgtacgtcgtgccggcctttaccggtctgggcgcgccttactgggacccttatgcccgcggcgcgatcttcggcctgacccgtggcgtgaactctaaccacatcatccgtgcgacgctggaatccatcgcctatcagacccgtgatgtgctggaagcgatgcaggccgactccggtattcgtctgcacgccctgcgcgtggacggcggcgcggtggctaacaacttcctgatgcagttccagtccgatattctcggcacccgcgtggaacgtcctgaagtgcgtgaagtgacggcgctgggcgcagcttatctggcgggcctggcagtgggcttctggcagaatctggatgagctacaggaaaaagcggtcattgagcgtgaattccgtccgggcatcgaaaccactgaacgtaactatcgctacagcggctggaagaaagcggtgaaacgcgccatggcgtgggaagagcgcgacgagtaattttcccctcaccctaaccctctccccatgggagaggggattattcggtgccccgttcctgcccttcccctctccctcagggagagggccggggtgagggtggtatctcctctctctgtgttaaacttcaggcaatttctttcttaaacgagtctgtaatgaaacgagaacttgccatcgaattttcccgcgtaacggaagctgccgcgctggcgggctataagtggctgggccgcggcgacaaaaacgttgccgatggcgcagcggtacacgccatgcgcatcatgcttaatcaggtcaatatcgacggcaccatcgtgattggcgaaggtgaaatcgacgaagcgccgatgctctacatcggtgaaaaagtcggtaccggcaacggcgatgcggtggatatcgccgtggatcctatcgaaggtacccgcatgacggcgatgggccaggccaatgcgctggcggtgctggcagtgggcgataaaggcaccttcctgaacgcgcctgacatgtatatggaaaaactcattgtcgggcccggcgcgaaaggcgccatcgatctcaacctgccgctggaacaaaacctgcgtaacgtcgctgctgcgctgcaaaaaccgctttctgaactgacggtcaccattctggcgaaaccgcgccacgacggcgtgatcgcggaaatgcaaaagctcggcgtgcgcgtgttcgccattccggatggcgatgtcgccgcatccattctcacctgtatgcctgacagcgaagtggacgtgctgtacggcatcggcggtgcgccggagggcgtggtgtcagccgcggtgatccgcgcgctggacggcgacatgcagggccgtctgctggcacgtcacaccgtcaaaggcgacagcgaggaaaatcgtcgcatcggcgagcaggagctggcgcgctgcaaagcgatgggcattgaggcaggcaccgtgcttcagctggatgatatggcgcgtaacgacaacgtgattttctcggccaccggcatcaccaaaggcgatctgctggacggcatcacccgtaaaggcaatatggcgaccaccgaaacgctgctgatccgtggcaaatcgcgcaccattcgccgcattaaatccattcattatctggatcgtaaagacgtggacgtacagcgacatattctctgaaatcatttgatcaaatgagctttccggcccctgcgggctggaaatgtcagggttgagaaacgaagataaggcatcgcatcagaacaggagataatcatggcggattgggtaacaggaaaagtcgtaaaggttgaattctggaccgatgcgctctttagtctcaccgttcatgcccccgttaatcccttcactgccggtcagtttgccaagctgggactggagattgacggcgagcgcgtacagcgcgcctactcttatgtcaatgccccttccgatcccgatctggaattctatctggtcacggtgccggacggtaagctcagcccacggctggcggcgctgaaacccggtgatgaagtgctcatcgtggccgaagccgccggtttctttgtgcttgatgaagtgccggactgcgacactctgtggatgctggcgacgggtacggcgattgggccttatctgtcgatgttgcaggaaggcaaagggctggagcgctttaaaaacctggtgctggtgcacgctgcgcgttacgccgcggatctcagctatctgccgctaatgctggagctgcaaaagcgctacgaaggaaaactgcatatacagacggtagtcagccgtgaaacggtttccggctcgctgcacgggcgcgtaccggcgctgattgaaagcggagaactggaaaaagccgtgggactgccgatggataccgcgaccagccacgtgatgctgtgcggtaatccgcagatggtgcgtgatacccagcagttactgaaagatacccggcagatgaccaaacatttgcgtcgccgtccgggtcatatgaccgctgagcattactggtaattaacggaacttcacgtccagcgtgtctttgccgaacttattttcgccctgggtgcccacaaacgcgcccaggtcgatcaagagcattaccatgatcagcgtcggaatgaagcgtccgaccgcccagacccagacgccgcccagcaccgcccagttcccggccagtaagatccacgctaccaccatcagtaacgcccacaggccggatttattgcgatcgtgcagccgcttgacggttacgcatgccgtcggccatatcaggcacaccagcgcaaaagcggccatttgcagatccatcagtcctttaccggcgagcgtaaacagcaacaccatggccagcgcccagagcgcgatccagatccagaagtcacgacgcccaatacgtcctttaaatgagaataaccactgctgtatggtcatgtaaggttccttataatcgtaatgccgcgtagtttaccctgatcagcgccgtttttgacaagcgggacggttatcgttttaatcggcaacacattgcacagaggacgatgttgatgaagatacgggatttacgggtttgcctgttgctttccctgctgctgaccagcctggcaggccgcgccgtggacgcgccgctggcggcaacggccccttacctggtgacgggcgcgcccacctttgatctctctatcagcgcgttccgggaaaaatttaataccgccaacccagggcttacgctgaacgagtttcgcgctatagattcgcgtaccgatcgcgccagcctgacgcgggccgccagcaagattaacgataatctctatgcctcaaccgcgctggagcgcggcacgctgaagatcaaatcgatgcagatcacctggctgccgatccgcgggccggatcagaaagcctcgaaggcgaaagcgcaggaatatatggccgccgtcctgcgcgttttcactcccacgttgaccagcgcgcaaagtctgcaaaagctgcaaaaaattctcgctggcggtaaaggcaaagtttatttcgccgaaaccgagggcgcattgcgttatgtagtggcagataacggcgaaaaggggctgaccttcgctgttgaaccgattaagctgacgctatctgagacacctgaaggcaacaataaatgacaaaaagcaaagcctttgaggggatgaatctctatactgttcacagaccatgctgtcctgaacggcagccatattccttgattcgcttaacgcgtggagaatgaaaatgcgacatcctttagtgatgggtaactggaaactgaacggcaaccgccacatggtaaatgagctgattgctaacctgcgtaccgaactggctggcgtatctggctgtggcgttgctatcgcgccgccggacctgtacctggatctggcgaaacgtgccgcagacggtagccacatcatcctcggcgcgcagaacgtcgacgttaacctgtctggcgcattcaccggtgaaacctccgcagaaatgctgaaagacatcggcgcaaaatacatcatcatcggtcactctgagcgtcgtacttaccacgcggaatccgatgagttcatcgctaaaaaattcgctgtgctgaaagaacagggtctgatcccggtgctgtgcatcggtgaaaccgaagcggaaaacgaagcgggtaaaaccgaagaagtgtgcgcacgtcagatcgacgcggtgctgaaaactcagggcgcggccgcctttgaaggcgcagtgattgcctacgaaccggtctgggctatcggtaccggcaaatccgctacccctgcgcaggcgcaggcagtacacaaattcatccgcgaccacatcgcgaaagtggatgcgaacgtggctgagcaggtcatcatccagtacggcggttctgtaaacgccggtaacgcagctgaactgttcgcccagccggacatcgacggcgcgctggttggcggtgcttccctgaaagctgacgccttcgcggtgatcgtgaaagcggcagaagcggctaaacaagcgtaaaaaacctttgcggcgggtggcgcttcgctaacccgccctgcggttctccaggcccggtaagcgccagcgccaccgggcttttttacagccgtcccagaatactgaaccacagataatccagcggcagcagcaccagataggttgccaccgccagcgccagacagagcagcattcccgcccgcgccggcactttgcccagcgccatcgccaccacgataggcgatgcctgatacggcagcagcggcgtcgaataccccagcacctgaatcatgatcaccgacagcagcggaaagcccgtcgcatcggcgaaactctgcgccagcgtggtgtacaacgccggtacgccgttggcggtcataataaagtttaacgccgtggtgatgccggtcagggcaagaaaactggtgaagggattatcgggatcgagcggcatcacgtgcagcagcgcgccgcctacggcgctgccaatgccggtctgagtcacggtgatcgcaagccctaaaatgcccgccacataaatacaggtgcgcatattcacgccgctggcaaactcgtcgccggtgatgaaacccacgcgcggcaacagggtgacgcatgccgccgccagcccggtccacgccggaccgataccgtgccagctctcgctcacccacatgatcagcaccaccgccagcagccaggcgagtcgtttttcctcccggctcatcggcccggcgggagccagctcgcgcggcgcatgtggtttaccgggaaacagccagcatatcagcccgatcagcaccaggcctttcagaatgccgagcaccggcgtatgcagcagcaggtagggcagatagttaagatgaatgccgtaagagccttccgccgccccgctcatcaccagattcggcacgttagcaggcagaatggtcgccgacagctgaaaagtgccgaagcccaccgccagcgccagcccgtaccaggcgcgcgtgccgtcgttgatcccggcccgcgccgccattgccgcgacaatcggcatcaatagcgctatacgccccatgttcgacggcatgacaaatgccagcgcatagctcagcagtaccacgctgccgaccatcaacggccaggagtcggtgagcctcgccgacagcgccctcgccgcccggtctgccagcccggttttgcggatcgccacgccgagcacaaatccgctgaataccagccagaaggctgaagaagcgaagccgccgaaaatgacgtccggcggggcgatttttgccaccatcgccgccgcaaaaaacaacagcgcggtaataaactccggcagcagtgacgttgcccagagcacgatggtgacgccaacaatcagcgacggaaggaacagcggatgtgaaaaccagagcgacatacctgtctcctgacgatattttcagcaagtctacggcgacaactccgccccgtaaacgctaattattcgcaggttatttgaggatcgcacactcatgatcctggatttcctcggcggaggcgcggttaagcagcagcagattgcggctggtcgccagcagaacaaaggcaccatccgcctgttttaccattgccagcgcatagcggcccatatgctcgcgcgcgtccggcacttcttcggccagcattaaaaacgggctgcgcttcaccagttcgttttcagtgacgcgacgggccagatagtcatgcccgcgcagcccgccggggaacggcagccagcggctgctgatcgcggcgctgtgttcatcaagcgcggcgcggacatcgggccgcaggcaggagatatgaatatggaaatgattttgcgtgcgtccgctgcgggaattaatggtcagcgataccgcctcatcaggcacaggcgcgccccggcgttcgctcataaaacgtcgcgcgctccacgcctgccagaaaaagttcggcgtttgcggctccagcagcagcgggctttccgtgccgttgattttataggttggcatcaacaggtactgcaacgggccattacgatctttgaacaccacgtacccacttttggggttaacctcggcgcagggttgctgatggggaagacactgttcgaaaacaatctgccgcagcgcattcggattaccggactgaagccacagccagacgcccgcaacggcggcgaggagaagaataatcagcaggatgaagatagagagaagtcgtttcattttacgttccggaaaaaacttttaccggaagggtaacgcaaaataatgaccaaataaaaacgctgcccgactcactcgtgtcgccgggcagcagaggataattaacgcttactgatctggtcgaaagtaccgccgttagagaagtgctctttctgggctttcgtccagccgccgaactcttcatcaatggtgaacagtttcagtttcgggaaggcgccttcgtattttttcgccacttccgcgttacgcgggcggtagaagtttttcgccgcgatctcctgaccttccggtgagtagagatacttcagataggcttcggccacggttttggtgtctttcttctcgaccactttgtcgaccacggaaacggtcggctcggccagaatggattcgctcggcgtgacgatctcaaacttgtctttgcccagttcgttggtcgccagcagcgcttcgttttcccaggcaatcagcacatcgccaataccgcgttccacgaaggtattggtcgcgccgcgtgcgccggaatccagcacttcaacgtttttaaacagcgacttcacgaagtcctgcgctttagcctgatcgttgttgttgtgatgcagggcgtagccccaggccgccagatagttccagcgtgcgccgccggagcttttcgggttcggcgtgatcacagagacgcccggtttgatcagatcattccagtcgtggatttgtttcgggttgcctttacgcaccaggaagacgatggtggaggtgtacggcgcggagttatccggcaggcgtttgatccagtttttgtcgatacggccacgttcggcaatcgcatccacgtcataggccagcgccagcgtcaccacatcggcctcaatgccgttgataactgaggttgcctgtttgcccgagccgccgtgcgactggcggatcacgacgttatcgccggtttcctgtttccagtgagcactgaacgctttgttgtactgatcgtacaactcacgcgttggatcgtaagacacgtttaataactgaatatccttcgccagaacactgccggatgccagcagtaaagttaatcccacgccccatttgttcattgctcactctcatatgctgttgtgttgtgatgaaagcagcgtgccagaaagcgaaccaatgattaaagaataaaaaaagattggctataacagtgaggaataagaaaagcatccccctccgggcggagagggatgagaaggcattaatagagttttttggcacagtccagccagtcgcctttgaacggacgcttcatgttctcgatagcgtcgatgatgtcgtggtgcaccattttttcgttctgaataccgacgcaacgaccaccgtggccctgcagcagcaattcaatggcgtaagcgcccatgcgggaagcgagaatacggtcgtaaggcaccggcgaaccgccacgctggatgtggcccagtacggtggcgcgggtttcacgctgcgtttcttcttcgatgtatttcgccagctcgtcgatgtcgcagatgtgctcggtgatggcaacgatggcgtgttttttacctttcgcgataccggctttgatctcgttaaccagatcttcgcggctgaactccacttccggcagtacgataaactcacaaccgcccgcgatagccgcagccagcgtcaggtcgccgcagtaacggcccatcacttcaacaatggagatacgctggtgagaggaagaggtgtcgcgcagacggtcaatggcttcaacaaccgtgtgcagcgcggtgaagtaaccgatggtgtagtcagtacccgccacgtcgttatcgatggtgcctggcagaccgatgcacgggaagcccatttcagtcagacgcttcgcacccatgtatgagccgtcgccgccgatgaccaccagcgcgtcgataccgcgttttttcatgttttcgatagccacagcgcggatatgctcttcgcggaattccgggaagcgtgcggagccaaggaaagtaccgccacggttgatcatgtcggacacgctgtaacggtcgagctgcaccatacgatcttcgtaaagacctaagtaaccgtcataaataccacaaacttccaggccttccgttaatgccgcgcgaaccacgccgcgaattgcagcgttcatgcccggcgcatcaccgccacttgtcaacacaccgattttcttaatcatgactacctctgaactttggaatgcaaaatgaattctgttgcccgaagcgactcccccgaaggagtgaacaacgatgttgcgaatagtatatcaatatctctgtgctgaattgattcaggtcaggcgaaatggcgctaatttctgtacaaaaaagtggcctgactcactcttttacaaccgatcacaaagcattgattgacgtacccttttcctgaggtactaccgaacaaggatcctgatggatgatgacatccgaccccggaaagcgttgcaggatcgcctgctcaacctgttcagccaccagatgcgcctgaacaaggggaagattgtcatccatttccaaatgaatctgtataaagcgggtcggccctgactgccgcgtgcgaaggtcgtgcgcgccgctgactccaggccagcgagtgacgatttcgaatatttcctgacgttcgatgtcaggtaacgcgcgatccaataatgactgaaccgcctcataacccatacgtagcgcgctgtacaatatataaacaccaatacctaatgcaaataacgcatcggcacggtgccagccataccaggacaggccaagggcgatgagaatcgcgccattcatcataacatcagactgataatgaagcatatccgcccttaccgcctggctttgggtttttcttactacccagcgctggaaggttacaaggatgactgtgcttatcagggcaatcacagtgacaaccaccccgatccccggcgcattgagcggttccgggcgcgccagatgttgtatcccggtcaaaaacaggaacagcgccgagccggaaataaacatactttgcgccagcgccgccagcgattccgccttgccgtgaccaaatgtgtgttcgtcatccgcaggctgtaaagagtaacgcaccaccagcaggttggtgagcgaggcggcaatatccaccagagaatccaccagcgccgccagaatgctgaccgacccggtgtaccaccatgcgacgattttgatcagcagtaacgcgcttgcgaggatcgtcgccgcaatcgccgcccggctgaccagccgtccataagattgattcatagagactcctgccagaacacaggaaccagtataacggatgaaaaaagcctcattgtgatgaaaaggcacatcgaagggtgtgaaattgcagatttaaaggatcccggtggcaaattgcgggcaaaaaaaacccccacatcatgtgggggaagacagggatggtgtctatggcaaggaaaacagggtgttactggttactaccggtactgctgctactcgataacttcaacgatgaactttgctgcatttgcgcgacgtcgcgcagttgtttcattcgctgatcgtgtttcttatgtaaaaccgcttgctgctccggcgttagcaggtggtacatctggttgcgaaccctggccatttcgacctggcgaacaacctgttcttgtgccattttttctgcctgagcgcgcacagcgctttcatcaaatttttgtgcggtgacaaggttgtgcattgtctccacgtcgctcacgttgacagggggttggtcgtgccgtgcccgctgcatgagatcgcgtaactgctgtcgctgatgttcggttaaactaataccgtcaaacatgtggctctggctgctacgctgagtaagtccatctgctggatgccagttatcgcctgttacgtctccagttgcctggctgactgcactgaatgccaggcttgaggccatgacggcagcggtaacattgcgcatcacttactcccaaaatcttttgtttcgcgattcaacgagagccagtgtacggttcaggctgaaaactagcgtcagggggtgtaaaacaacgtaaagtcatggattagcgcgccttgatgacgtaatttctgcctcggaggtatttaaacaatgaataaaatcctgttagttgatgatgaccgagagcttacatccctgttaaaggaactgctcgacatggaaggctttgacgtgttggttgcccatgatggggaacaagcgctcgacctccttgacgacagtatcgatttacttttgctcgacgtgatgatgccgaagaaaaacggtattgatacacttaaagagcttcgccagacacaccagacgcccgttattatgttgactgcacgcggcagcgaactggatcgcgtacttggccttgagctgggcgcggacgattatctgcctaaacccttcaacgaccgtgagctggttgcgcgcatccgcgccatcctgcgccgttcacactggagcgagcagcagcaaaacagcgataacggttcccctactttagaagtcgacgccttaagcctcaatccaggccgtcaggaagccagctttgatggacagtcgctggaacttaccggcaccgaattcacgctgctttatctgctggcgcagcatctgggccaggtcgtttcccgtgaacatctgagccaggaagtgctgggtaagcgcttaacgccgttcgatcgcgccatcgatatgcacatttccaacctgcgccgtaaattgccggaacgcaaagacggacatccgtggtttaaaaccctgcgtggtcgcggctatctgatggtttctgcttcatgattggaagtttgactgcgcgcatctttgccattttctggttaacgctggcactggtgctgatgctggtactgatggtgccgaagctggactcccgtcagatgacggagttgctcgacagcgaacagcgccagggcgtgatgatcgaacagcatgtcgaagcggaactggccaatgatccgccgaacgacctgatgtggtggcgcagattattccgcgcgatcgacaaatgggcgccgccgggtcaacgcctgctgctggtgaccagcgaagggcgcgtgattggcgcagaacgcagcgaaatgcagatcattcgtaacttcatcgggcaggcggataactccgaccacccgcagaagaaaaagtacggtcgggtagagctggtagggccattttccatcagggatggggaagataattaccagctctatctcattcgtccggccagcagctcgcagtcagactttattaacctgctttttgaccgcccgttattactgctgattgtcaccatgctggtcagttcgccattgctgttatggctggcgtggagtctcgccaaaccggcgcgtaagctgaaaaatgctgccgatgaagtggcgcagggtaacctgcgtcagcatccggaactggaagcggggccgcaggaattcctcgccgccggggccagctttaaccagatggtgacggccctggaacgcatgatgacctcgcagcaacgcctgctttctgatatttcgcatgaactgcgcaccccgctgacgcgtctgcaactgggcaccgccctgctgcgccgtcgcagtggtgaaagcaaagagctggagcgcatcgaaaccgaagcgcagcggctcgacagcatgatcaacgacctgctggtgatgtcgcgcaatcagcagaaaaacgcgctggtcagcgaaaccatgaaagcgaatcagctgtggagcgaggtgctggacaacgccgcctttgaagccgaacagatgggcaagacgttgacggtgaccttcccgccagggccatggccgctgtacggcaacccgaacgcgctggaaagcgcgctggaaaacatcgtgcgtaatgcgctgcgttattcacacacgcagattgaagtgggatttgcggtggataaagacggcatcaccattcacgtggatgatgacggtccgggcgtcagcccggcagatcgcgagcagatttttcggccgttctaccgcaccgacgaggcccgcgatcgcgagtccggcggcacagggctgggcctggcgattgtggaaaccgccatccagcagcaccgcggctgggtgaaagccgacgacagcccgttaggcggcctgcgcctgaccctctggctgccgttgtatagcaagcgagcctgatgtagcgccctctccttcaccgggagagggcaacgccggttacccgcgcaaccgccgcgaactgtcttcgattttgccgctaatccgccgtttctgcatggttcttgcccagctcaccgacagccctgccgctgacagcaggcgatgatactgctcatcgtcgaacggcgtatgccaggcaatgacacccgcctcatggacgctgatctcgctgcaacgggataccagctccagcggcgcatcgctgaacaccttcccgcccgccacgatacggtacagccagccggtgtgaccgcgatcctgcatcagcgtcgccatattgggaatgccgaagtggaaattgagcttaaagcacggcgagcgcggctgcgtcacctggatcagcgcctcgccccagcggaaaatatcgccgatatacacgttcttctccgtcagcccgacggtcgacagattctcgccaaaggccggggcgacaaagagcgccgcctggtccgggaaatcccgcgcccattgggcgtaatgttcccgcggatagtggcataacgcacggtcggggccgccgtggatctttttctccgcctgctggtcatctttcaggccgcgttccgtaagcgtcagttcgccatccacctgcactttcgcaatggcgctcgggcggctgcccggataatcgcgcaccttgccggaaaatacctccatcggatattgcatatcgtctccctttgtcataattccactgcgcttcaggctggccggaaacgccgccaaatacaatatttttgcggcatcagcgcgcaaaaaaagtacaccactggcgtgaaatgctgcaagccgtgctatcacttagctaacttctgaaacgccatttcacattcaaggagtcaacaacatgtccagtgatgcacgctttacgggcgtctggtgcccgtccattacgccgatggaaaccgacggcaagatagattttaacggcctgcgccagcatctcgcccgcctgaccgacgccagaatcgacgtgattctgctgatgggcagcatcggcgaattcgcttcctttacgctggaagagcggctgtcgctgatccgcgaagcacgggccatgtcgtcgctgccgatggtggcaaacgtctcctccacttgcgtgagcgatatactgcgtatggcgcaggcgtcctttgacgcgggctacgacgcggtgatgatcctgccgccctactactacggacagacatctgcgcagctgctcagctactaccgcgcgctcgggcagcagctgaccggcaaatggttcgcctataactttccggcgcgtaccggctgtgatctgacgccggagcttatcgccacgctggtggcagaattccctgacttcgccgggatcaaagacaccgtggactgccagtcgcacacccgcaatatgatcctcgccacccgggcggtacgggaggattttgccgtactctccggctacgacgagtattttattcccaacaagctggcaggcggcgccggggtgatttccgggctgaataacattgtgccggagctgttcgtccgcgcgcgtgaagccttcgcccggggcgatctgcaaactttacagcaggttcagcaggagattggcaagctgtcggcgatttacgccatcggcgatgattttgtcaccaccattaaaaccgtggtggcgcgcaaatttggttattgcggaacgacatcgcgtaacgcgggcggcacgctgaacgtcgcgcagacgcgtgccatcgacgaggttttcggcctgtagcgggcaaaaaaaagcccccgtcggcttaccgacaggggctggacagattcaccagaaggtgagcaggacttattttttagccgcgaaacgtgccgctgcttcgtcccagttaaccacttcccagaacgccttgatgtaatccgggcgtttgttctgatatttcaggtagtaagcgtgttcccacacgtccagacccaggatcgggaagccggatgcgccagaaattgcttcacccatcagcgggctgtcctggtttgcagtagagactacagccagtttgtcgcctttcagtaccagccacgcccagccggagccgaaacgggtggcagccgctttctcgaactcttctttgaatttctcaacagagccgaaatcacgttcgatagccgctttcaggtcgccctgcagggtggtaccggttttcaggcctttccagaacaggctgtggttagcgtgaccgcccgcgttgttacgcagtacggtttttttgtctgccggcagctgatccagtttggtgatcagctcttcaaccggcaggttagcgaattcaggcagactttccagcgctgcgttagcgttgtttacgtaggtctggtggtgtttggtgtgatggatttccatcgtctgcttatcgaaatgcggttctaaagcgtcgtatgcgtatggcagggatggcagtgtataactcatattcatctccattattgtcgggcggctgaagtgttaacgccgcgtaagcagttggttcattatagttaattaactggtattgaaaatgtttatcaatgccgtagtttctgtgtggttataacttttcgttatgacactgtcaattttggcgctaagcgttgccgccactggcttggcgtcgcgcccgtttcacgggtaaacaccaccgagaaatagttgctgtcttcgaagccgcagcacatggcgatttcgccgattaacagttccgtatgttgcagcaaatactgcgcgtggcagatgcgcagctggcgcagatagttgttgatggtcatgccggtctgggtgcggaattgctgccgcagcgcgcgttcgctgcactggttttgctcgcagaacgtctccagcgcaaaggcccggttcaggctgcctgccagcgccgtgatgagcctgtcgagcagcgcctcgctggcggtagccgacaggttatccgtggcgtagcgatgccgtttaagcgtcaggatcagctgcgcgaacagcgcctccgccagcgggttcgccagctcgtccgttctggcgctctcctgctccagctgggtgatcacctgccgcgcctgcgtcatgccggtgctgccaagccgccagtagggcgactgctcacggccctgtagccccggaatatgcgccgcccagtccagcgccagcgtcaggcgctccgggcagtagataatattttgcagcaccaggtcgttcaccgaggcgtaagagtggcgatcttcggcgcggatatagaacagatcgccgcgggtgatgcggtaaggccggtcgttcagaatgtgcagcccgttgccgcgccacaccagcaccagttcattaaactcgtgggaatgctccgcaaagacgttttgcgggtagcgatccgccaccgccaccgcctgtccggtacgggcaaaaaaatcggctttgcgaagaattaactggcctgccacaaggtcacctcaacagcgattaacctttcattattagctgttttctggcgaaaatacggtgataaatctctcgttacgcgcagctactgtaaaagcgtgtcgcgcccctggcggatatcgcgcggcgaccagtcgaactcccggcgaaaaagcgttgaaaagtggttactgtcgccgaaaccgcagcgaaaagcgatgtcagtgacgctatggtcgctgtggcgcaataaatgtcgcgctttgatcagccgcaggcgattcagatagcgctgcggcgtcataccggtgtactgcttgagctgacggtgcagggtgcgcagcgacagcgagaactgatccgccagcgactcccagcacacctcttccgcaaaatgatcttccagccacgacatcaactgattcaggcgcgcatcgttattcgccgccccttccatctggctgctgcgacgcaacagcaccagcaactgcataaagaggatctcacggttcgccagcgccgccgtatccttgccctcatccgccgtttccatctgcccgacaatctggcggatctgttgcaatacgccctgattcacgcgccagtgagacggatagtgcccgtcctgctcctgcggcagtaactggtttaagccggataagaactggaacgcgtccggggagcggtacagcacattggtcaggcacagattatcggtgtgctcatagagatgccggtcatgatcgcgtacaaagcacacggtgccgccgctgatggtgtagggctgaccattgaagacgtgaataccggtgccgtgctcgacgatcacaatctcatgaaaatcatgatgatgttccgggaatgccgcctggggcagccggggttcaatagcaacaggcgtataacctgatggaaaaaagtccacgctgtgtaatacggtcatagcaacccctgtcgatgagaaacgttctcaatatagtaattaacgccctctgttctcaccttgaatttttgacagcaaagcgcgcaaagcctgtcgatttttcaagaaactgtcggaaagttcaggaaatgcggcggcggtcacagcggctgaaaaaccgctgataagtggaaattgtgaactctctcacgttcatctttggtttcttgccagcggcggtttgggcctgtcactggcaagaaggtgatcctgctggcccttttttagactggcggcaatgactcaccagaggatcgctccatgacttttcgccattgcgtcgcagtcgatttaggcgcatcaagcgggcgcgtaatgctcgcccgcttcgacgttgagccgcgtacccttacgcttcgcgaaattcatcgcttcagtaactgtctgcaaaaaattgacggcaccgagtgctgggatatcgacagcctggaagcggaaatccgctgcgggctggataaagtccgtcagcagggcatcgccatcgacagcatcggcatagatacctggggcgtggattacgtgctgattgatgcgcagggcgagcgtgtcggtctgccggtttcctaccgcgacagccgcaccgatggcgtaatggcgcgggcgttagcgcagcccggtaaaaccgatatttatcgtcgcagcggcattcagtttttacccttcaacacgctctatcagtttaaagcgttaagcgaacagcagccggaactgatggcgcgcgtcgcccatgcgctgctcatccccgactatttcagcttccggctgaccggccagctcaactgggaatacaccaacgccaccaccacgcagctggtaaacattcacaccgacagctgggacgagacgctgctcgactgggcgggcgtacccgccgcctggcttggcacccccacccatcccggcaatgtgatcggtcactgggctgacgtgccggtggttgccgtcgccagccatgacaccgccagcgcggtgatcgccgcgccgctggccggcaaagacgccgcgtatttatcctccggcacctggtcgctgatgggctttgaaagcaaaacgccctacaccagcgatgaggcgcttgccgctaacatcaccaacgaagggggcgcggaaggccgctatcgtgtgctgaaaaacatcatgggcctgtggctgctgcaacgggtgctgaaagagcagaacgtgcaggatttggcggatctgatcgcccgcaccgccgccctgcccgcctgccgtttcgtcatcaacccgaacgacgcgcgctttattaatccggaaaacatgagccgcgaattgcaggccgcctgccgggaaaacggccagcccgtaccgcacaccgccgctgaactggcgcgctgcatttttgacagcctggcgctgctgtatgccgatgtgctgcacgaactggcgcagcttcgcggtaaagccttcagccagctgcatatcgtgggcggcggctgccagaaccagttgctcaaccagctgtgcgccgatgcctgcggcatcaccgtggtggctggccccgttgaggcctcaacgctcggcaacatcggcgtgcagttaatgacgctggacgagctgaacaatgtcgacgctttccgtgaggtggtggcgtccagttacgccctcaccacttacacccctcatcctgataatgaaattgctcgctatgttgcgcagtttcagcaaaaacgaccaacaaaggagctttgcgcatgaccactcaacttgaacaggcctgggaactggcaaaacagcgcttcgccgcggtgggcattgatgtcgaggcggcgctgagccagctcgatcgcctgccggtgtccatgcactgctggcagggcgatgacgtcgccgggtttgaaaacccgctgggcggcctgacgggcggcattcaggcgaccggtaactatccgggcaaggcgcgcaacgcaacagagttacgggccgatctggagcaggcgctgagcctcattccagggccgaagcgcctgaacctgcacgccatttatctggaatccgacgagccggtagcgcgcgatgccatcaaacctgaacactttaaaaactgggtgagctgggcgaaagagaaccagctgggcctggatttcaacccgtcgtgtttctcgcatccgctttccgccgatggctttaccctgtcccacgctaacgatgagatccgccagttctggatcgaccacgtgaaagcttgccgtcgcgtgtcggcgtatttcggcgagcaactgggcacgccgtcggtgatgaacatctggatcccggacggcatgaaagatgtcaccgttgaccgcctcgcgccgcgtgagcgtctggtcgccgcgctggacgaggcgctgagcgagaagctgagcctggcgcatcacattgatgcagtggagagcaagctgttcggcatcggtgccgagagctacaccgtcggctctaacgagttttacatgggttatgccaccagccgccagacggcgctgtgcctggacgccggtcacttccacccgaccgaagtgatctccgacaaaatctccgctgccatgctctacgtgccgcgcctgttgctgcacgtcagccgcccggtgcgctgggacagcgaccacgtggtgctgctggacgacgaaacccaggccatcgccagcgagatcgtccgtcataacctgtttgaccgcgtacatattggcctcgatttcttcgatgcctccatcaaccgtatcgccgcctgggtgatcggcacccgcaacatgaaaaaagccctgctgcgcgccctgctggagccgaccgacgaactgcgtcgcctggaagcgagcggtgattacaccgcgcgtctggcgctgctggaagagcagaaatcgctgccgtggcaggcggtatgggaaatgtattgtcagcgcaacgacacgccggtcggcagccagtggctcgacagcgtgcgggcgtatgagaaaaccgtgttggccgaacgccagtaaatacaccgcccggcggcgcttcgcttgccgggcctacgcatgacatgtaggccgggtaagcgtagcgccacccggcattgagataaatgtaggccgggtaagcgcagcgccacccggcgttttcaaaggaaccacaagactatgcagaacatcactaacgcctggtttgtccaggggatgatcaaagccacctccgacgcctggctgaaaggctgggacgagcgtaacggcggcaacctgacgctgcgcctggatgaggcagacatcacctctttcgccgcagatttccataaagagccgcgctacatcgccctgagccaaccgatgccgctgctggctaacacgccctttatcgtcaccggctccggtaaattcttccgtaacgtgcagctcgatcccaccgccaacctcggcatcgtcaaggtggacagcgacggcgcgggctaccacattctctgggggctgaccgacgatgccgtaccgacatcagagctgcccgcgcatttccgctcacactgtgaacgcatcaaagcgacccatggccgcgatcgcgtgatcatgcactgccacgccaccaacctcatcgccctgacctacgtgctggaaaacgactctgaccttatcacccgcaaactgtgggaaggcagcaccgaatgcctggtggtgttcccggacggcgtcggcattctgccgtggatggtgcccggcaccgatgaaatcggtcaggccaccgccgatgcaatggcgaaacattcgctggtgctgtggccgttccacggcgtctttggtagtggcccgacgctggatgaagcctttggcctgattgacaccgccgaaaaatccgctgaagtgctggtgaaggtgtactcgatgggcggcatgaaacagaccatcacccgggaggaattaatcgccctcggcaaacgctttggcgtgacgccggtgcagtccgctttagatttgtacaaataacaacatcgcgccccgctcacgaagacggggcgaataccacctgccatccctacaaaaactaactcgtggagtacaagcaatgaaaattaaagcaagcttaatcctcaccgttgctgcgctggcgttgtccggttccgcattagcagaagtcaaaatcgccctggtggcaaaatcattaggtaatggtttttttgaagcagcgaacgtcggcgcgcaggaagccgccaaagagttaggtgatgtaaaagtcatttataccggccccaccaccactaccgccgaagcgcagatcgaagtgctgaacggcttgatcgcccagggggtggatgcgatcgccatctccgccaacgatccggacgccgtggtgccggtgctgaaaaaagcgatgcagcgtggtatcaaagtcgtctcctgggactccggcgtggcgaaagccggccgccagatccatctgaatccctcgaacaatgcgctgatcggcgaaaccaacgtcaagctcgccgccgaagcgctgaaggcgctgaacgtcgaaaaaggcgatgtggcgatcttaagcgccacgccgacctctgcgaaccagaacacctggattgcggaaatgaaaaaggtgctgccgaagtatccgtccgtcaatctggtgaccaccgcctatggcgacgatctgtctgacaagagctatcgcgaagcggtgggcctgctgaaaacatatccggatctgaaagtgatcgtttcgccgtcgtcggtcggcatagtagcagccgcgcaggcggtgaaggatcagggcaaaattggcaaagtgtacgtgaccggtctcggcctgccgtctgaaatggcgggggcggtgaaatccggcgcgaccaaaagtttcgccatctggaacccgatcgatctgggctatgccgccacttacctggcggatgacttagtgaaaggcagcgccaccaaaaccgaggccagcatgggcaaactcggcaaagtgaaactggatgcggacggcagcggcgcgatggctgagccgttcgtctacgatgccagcaatattgataagttctccaaaattttctgatccgttttctgacatacggcgggtggcgctgcgcttacccgccctacaagaaatctcgttatgcggagaactatcatgacggcatccacccctctgctgtcgctcaagggcatcaccaaggttttccctggcgtgcgtgctcttgagaacgtgcagctcgatctctggcccggcaaagtcaccgcccttatcggtgaaaacggcgcgggcaaatcaacgctggtcaaagtgatgaccggcatctatcagccggaagaaggcgaaatcctctataaagccattcccattaacctgccggggccggaagcggcgcacaaagtcggcattaccgccatccatcaggaaaccgtgctgttcgatgaactgtcggtgacggagaacatttttgtcggacagtatctgtataaaggctttctgaagaagctggactggcccgccatgcaccagaaagcgcaggccattctgacccgtctggaagtgcagatcgatccgcacgcgacgctgaaaaccctgagtatcgcccagcgccatatggttgccatcgcccgggcactctcctttgacgcccaggtggtgatcctcgacgaacccaccgcggccctgtcgcagcacgaaattctggagttttaccagatcgttgagcgcctgaagcaggaaggcaaagcgatcatgtttatctcgcacaagttcgatgaaatcttcgagctggcggatcactacaccattttgcgcgacggggtgtacgtcggctccggcgcgatgagcgacatcactgaagagcgcatggtggcgatgatggtgggccgcgccatcacccagacctacccgaaaatagcctgcgagccgggcgatacggtgctggaagtgaaagatctctgccatcccacggaattcgcgcacatcaatttctccctgcgcaaaggggaaattcttggcttttacgggctggtgggggcggggcgtactgaactgatgcaggcgctgtccggcgtctcgcggccgtcgtccggcgagattgtgctgaacggaaaaagggtagagttccaccagcccgccgatgccattaacgccggtatcgtctgcgtgccggaagagcgccagaaacagggggcgatcatcgagctgcccatcgcccagaacatcagcctgccgcagctcggcaagcttaaccccaacggcgtactgaacgacgccagggagtgggcgctggcggatgagtacgcccgacgcctgcaagtgaaggccttcagctggaaacagccggtggaaaccctctccggcggcaatcagcagaaagtggtgattggcaaatggctcgccacccatccggacgtgatcatcctcgacgaacccaccaaaggcattgatatcggctcgaaagccgccgtacaccagtttatgtccgaactggtcgggcaagggctggcagtgatcatggtgtcgtctgaactgccggaagtgatgggcatggccgaccgcatcatcgtcatgcatgaggggctgatggtcgcggaataccgcgcgggcgaagccacggcggaaaccattgtcagcgccgccagcggcgcggcgcaggaggcggcataatgtggcaacaactgcttaaaaatcgcgaagccttgctggcgtcggtgattgtgctgatggtgatcgccattggcagccgcgcgccgtcgttcgtcgccccgggtaacctggtcgagatctttaacgacacctctattttaatcatcctcgcgctcggccagatgatggtgctgctcaccaaaggcattgatttgtcgatggcagctaacctggcgctgaccggcatgatcgtcgccctgctcaatttccactatccggcgatccccgtctgggcgttactgctgctggccaccgcgctcgggctggtgatgggcatcatcaacggcctgctggtgtggaaaatgggcatcccggcgattgtggtgaccctgggcaccatgagcatctaccgcggcattatttttctgctctccgacggcggctggatcaactctcaccagatgagcagtgattttctcggcctgccgcgcgctgccgtgctggggctgccgctgctgagctggtgcgccatcgccgcgctgttgctggtgggctacttcctgcgctacagccgcaccggacgcgcgctctacaccgcaggcggcaacgccaccgccgcgtattacaccggcatcaacgccggaaaaatgcagttcgtcagcttctgcttatccggagcgctggccggtttctgcggttacctgtggatctcccgcttcgccgtggcctatgtggatgtggcgaacggctttgaactccaggtggtcgccgcctgcgtcattggcggcgtcagcaccatgggcggtaccgggcgcgtgctcggctgtctgttcggcgcgctgtttctgggcgtcatcaataatgcgctgccggtgatcggcatttcgcccttctggcagatggcgatttccgggacggtgatcgtcattgcggtgctgctgaacgagcgcggcaataaacgtaaagggcggctgatcctgcgcgatgccgcgctggcgcgtcagaaaatggcggtgaaatcatgagcaaaattatgaccactgaagagatgaacacctcacccgccgccacgccatggctgaaacgcctgctgtgctgggagggctttttactggcggtgacggcggcggtgtttatcgccaatgcgctcgcgtcgccctatttcctcgacatctggaacctgtcggacgccaccttcaacttcacggaaaaagcgatcatcgtgctgccgatggcgatgctgatcatcgcccgtgaaattgacctgtccgtcgcctcgaccatcgccctcagttccacggtgatggggttctgcgcccaggcgggcgtcgatacgccgctgctggtctgcgtcgggctgggcgtcggcctgctgtgcgggctgttcaacggcgtgctggtgacgcgctttaatttgtcctccatcgtcatcaccatcggcaccatgagcctctaccgcggcattacctacattctgctcggcgatcaggcgctgaatgcgtatccggaaagctttgcctggtttggtcagggctacgtgtggggggcgttgtcctttgagtttgccctgttcatcgtgctggcgggcgtgtttgcctttgtgctgcaccgtaccaactttggccgccgcacttatgccatcggcaataacccgaccggcgcgtggtattccggcatcaatgtgaagcgtcacaacctggtgctgtttgcgctggtgggcctgatggcggggctggcctcggtgctgctcacctcgcgcctcggcagtacgcgcccgaccattgctaccggctgggagctggcggtggtgaccatggcggtgctgggcggcatcaatattctcggcggctccggcagcatggtcggcgtgatcatcgccgccttcctgatgggattagtcacctttggcctcagcctgcttaacgtgccgggcatcgtggtgtcgatcatcataggcgcgatgctgattgtggtgatttccctgccgattattacgcgacggattatgcagcgaagacgaatttaacggccgggtggcactgcgtttacccggcctacgatgtaggccagtacaagcgccgcgccgccgggcataaaaaatcacagcaagataaggagatttatcatgagctttatgttggcacttcccaaaatcagcctgcatggcgcgggggcaatcggcgacatggttaacctggtcgcgggcaaaaagtggggcaaggcgctgatcgtcaccgacgggcaactggtgaagctgggcctgctggatagtctgttcagcgcgctggatgcgcaccagatgtcttatcatctttttgacgcggtcttcccgaacccgaccgaagcgctggtgcagaaaggttacgccgtgtatcaggatgccgaatgcgattacctgatcgccttcggcggcggtagcccgatcgataccgcgaaagcgataaaaatccttaccgccaatcctggcccgtccaccgcctattccggcgtgggcaaagtggtgaacgccggggtgccgctggtcgccataaataccaccgcgggcaccgccgctgagatgaccagcaacgcggtgattatcgacgccgaacgtcaggtcaaagaggtgattattgatgccaacattattcccgatattgccgttgatgatgccagcgtgatgctggaaatcccggcctccgtcaccgcagcgaccggcatggatgcgctgacccacgcggtggaagcctatgtgtcccttggcgcgcacccgctcaccgatgccaacgcgctggaggctatccgcctcatcgcccaatggctgccgaaagcggtggatgacggtcataacctggaggcccgcgaacagatggccttcggtcagtacctggcgggcatggcctttaacagcgccggtctgggactggtgcacgcgctggcccatcagccgggtgccacacataacctgccgcacggcgtctgtaatgccattctgctgccgatcattgaaaactttaaccgccccaacgccgtggcgcgttttgcccgcgtggcgcaggcaatgggcgtcgatacgcgcggcatgagcgttgaagccgccagcgaagaagccattatcgccattcgcgcgctgagcgcccgcgtcggcattccgtccggcttcagccagttgggcgtcaccaaagacgacattgaaggctggctggataaagccctcgccgatccctgcgccccgtgcaacccgcgcgccgccagccgcgaagaagtgcgcgagctgtatctggaggcgttatgatccgcaaagcctttgtgatgcaggttaatcctgatgcccacgacgagtacgaacgccgccataatcccatctggccggagctggaatcggtgctgaaagatcatggcgcgcaccattacgcgatctatctcgataaagcccgcaacctgctgttcgccaccgtcgagatcgaatccgaagagcgctggaatgccgtcgccagcacggacgtatgccagcgctggtgggaatatatgtccgccgttatgccgtcaaacccggaccacagcccggtcagtagcgagctgaaagaggtgttttatctggagtgatagataacgcccggcagcgcttgccgggcgtgttaataaatctgtcagacagtgtttaaaggcgttttgataattcccttctcgccagctcagcgataaaaccgctacggctggtgtagtctttattatttacgacataagcatctattcttcttaacaaattttgcggcaaagtaatatttaatttcaccgatttgccatcgtatttagaggtatcaatatccacgatcccccacatgccgccctggcagtcttcatcatctttatgatcgttcatcgtacgtgctacaggtacgtcttttcctttctcactccggtagtccagatacgcatcaatagctgcatgagcatcagcgatcgcatcatcaatggtatcacctgcgaaatagcatccagccagatcgggcacaaaaccagaaaaagcgccgctttcggtctgatgtaaataaactggatatttcatggtttttcctcattcagaagtgacgtgcgccaacacgcctttggcacttatttttcgcctaattgcttcaaaatcttatgtaacgtaccggcagctaaatccttatttggatggggaaccactatcggctcaggctcaccttccttttcaaaaatgtgatgcgaacctctggtgcggacatgctcccaacctgcctttttcagcttcttcatgacttcagcgctcgtcatacattcctcaacgtccctgtaagctttagtggttattatacccaccacttttaaaatcggtcaattaaatggtgggtatggtggttactgaatgtgaggttctgtgcgaaaatttattccactacccatctcccccgtctccacattaatatgaaaatgacatgccgggctgccgtgcaggtatttatcgatcaccgcaaaaaggctgccgaaacgtagccggaaaatatcttcaaccgcgctgtgttgattgacctttagggcgacaggagataaacgggtcgccagcgcgcccgttagcagctggtactggtgcaaacggtcggtgggaatatcctgtaaggccagctcatccgcattgcgtaaacggtagaaatccaccgccagatcgaaaccgttccagcgggcaaaatcctgccgtttcatgcctgctttttgtgccagcgcctgcgctttttgccgtgccttttcccaggccgcgccgctttttttaccatcgtattcgccttgattgagctggcttgcgatcagcatctcctcgccgtttagcgaaaacagcagctggcgcagatcctccggccactcttccggcagaaaacgcaggcgggtgagttcagtgatatgccagttagtgaaggcgtagtagctgtcggcctgcaaaatggcgcggttccacagatggggcgagtgcacggcgttaagatgatcccactcctgctgatagtgctcaaacagttcatcaaaacgcggaacgtccttaaggatcaccgtctgcacgtcgatctccagcgggctggtaaagttaaggattttataggccggaacgtaggccgccagcgacggcgcctgaatgttgaacaacaggctgccatcggcataacggcgcacgccggtatcgttaaaatgcatatgaccgccaacgtgcacgccaatgccggtttttgccagcgcgtggctggtgtcctcgcgcggcgcgcgggccagctggaattttccctcgccaaaaatatcagcaagatccgcagccgcgccgttatcgaattccaccatcggaaaatggctgaaggtgaccagcgttttgttgagcgctctggcacgctgcgcaacatccgccatccaggcgacggtctgctgtttgtgcgtcagcatgctgttgtagcccgcctcgccggaacccaaaaactgcggtttatccgcgcgggcgtcggcggcgggcagatagacgttggcgtccaccgccagcaaccacaaacccggcaccggctccaccagataactgctgtcggcgacggtaaagcaggggccgtaaccgggctttttgtagatcccacccgttccctgggcgcagatttcatactgccgctggctgaaatcgctggcccgctgcgccgcctggtagctgtaattttccacgccgtaaccggagtacggcgtttcccagtacagatcctctggcgatggattgatgccgaacggccccatcgccgtcatgatcgcctgataaccgctgtggaccatctcctcgctgcaaatcgtcggcagtccggcgtcggttttgatccgcgctgtcgcgccctggtaaccctgacactcttttgcgccacggctgaagatacgctgggttttgccgccctcccccagaaaatcctcctcaccgcctggcgtggtaaaggggcggttcggatcgtggttgccgggggtggcgaaaaagcgcatgccatacttttgctcgtattcatgcagcagttttaccagcccgcgcacatggtaaggctggccgtcatcgctgaaatcccccggcagcgccacccatttgatgccctgctttccggcatcgtccagcgcggcgcgcagcgcaaaatagttctcattgaacagccgggtggaggtgagttgcgcatacatggaacgaataatagcgggcttgccgcttttgctgttcggcaggccggtaaaggcctggtccgcaaactcgccgtacacgtcgtgaaagtgaatatcgggcataaaggcgacgcggtactgatatttctctgccgctggtgatgcgccgctggcaatcagcagcaggggtacggccatcctgattagccttttcatttgtcctcccgataaaaatcaagacgccagctgacaggcgtgccgggcggtacgctgccatcgccgggctgcgccggggtttctgcgagggtgattttttgccagtcgcctgccgcgtcaggcgcgctatccggcagcggccgcaggcccggattccagccgcgtaacaccagcgcctcgccgcgctgcgcttttttcagcgtgctgaagtgcagagcgctgccccaggtaagcaggctgtaatgggcgggaaagcggatgccgtggggattggtgcgaaaacgtgaccagcccgaatccagatagccgctggccggggtgcgccagtgctccaccgtgcgccagaattcgtcactctgcccctgcgccatcggcagcacggcaaaattaaagcgcagcattccctgaatttgtgagtccggcgacggcagcaccatgcccgacgcgcgccctggccgccaggggagatccggcaggccaagccagccgacgctgcgaaacagcgtgagggcgataacgccggtctgctccgccgggagttcatattcccgtagccctgccgtcaccaccgccagcccgcgggtttcatggtgcagcatcaccaggctttgcactggccacagcgacgcgggcgcttcggtccagttttccgcctgccagcgttgcagcgcggcgggccggttttcccgttcgatcaggccaaagggctgatcggcaaaatgaaatgcctgtgcaatgcccaccgggatttccacctgtaagcggtgatcgcgcagggtgttgttaacctcaacgttgacgtcaagccagggggcgtcatggggcagcgagaccgtcatcgtcaccgccagcgtggcgttgcactgctgcgccgcgcgtgatgcggcatcggcaggcgccgggatctgccagcgcagcgtcagggtatcgttcagcgccccgcgctcgccgtgcgcctcctgcaaacagccgtcgctggtgacgcgccagtcctgcgagggcggcgaatagttgtagttatcccccgcgtcgccgccgtccaccagccgcagcacctgcgggtaacgctgttggctgcgtttatcgataagcgtcagctggtcaccgtcgatctccagccgcagccaggggttttccagcgcgctgatggtttcaccagcgtgatcaaagcccgcgggctgcccctcctgtaaatagagcgtgcgatagccgcaggcgggtaacgcctgtgccgccagcacaatctcgcatttacgataccaggtggtggaggtgctgttcgccagttcctgcacgatgatcgacatgtcctgtggggtgtcccgcagcagttgccagcggcagacggtgccgtcttcttccacgatgcgaaaatccgcatgaggggtgtacaaggtcagcgtgacctgcgcatcccggacgtggggcagcggattaaagaggatgatttttttgccatcctgccgggcagtgatcccttcggcgagcattttcatattcagatcaaacagctgctgcgcgctttccagcccgtccgttaaccgcgctttcaccatgctgttgacgcgatcggcattacagccgccgatgctgtcatgggcatgggatttcatcgcctcgcgccagatcgtctccagcgcctgctgtggatacggcagcccaagctgtctggtcaccgccagcagcggctccagcgtctggctgacgaactgctccagccgggcgttgagcaacttgatgtccatgcgcgtggaaaaaataccacgatggatacgcatatatttcgggctgagcagttcgccccggaattcgggcagcggtttttcaccgtcacgcagcgcggcaaaaaaatcgctgaagctgctgcgaataaagcggtactcctgctggcagtcgttgagccgatccagcatcgccgggacggcgtattcaaaaggcgactgatcgttaccgttcggcagcaacagcgcgtcggtgagcgaaaaacgcgcctgtttttcgaggatggcgggcagcacgcgtccggcctgttctacgtcgtccggcagccatttggcgcagccgtaaccccacggcagcaccgccgtggtgacgcgactgccgccctgcgccacccaactgaattcgctgctggcgacatcgtgctcgcaccagccgcgccagatcaccgccgcgtcgatggcgaattcccgcagaaacagcggcaactgcgcgctctggccgaaagagtccggcacgtagcccaccggcatagcactgcaaccccacgcttcgcagtcggcgttgcccagcagcagattacgcgtgatggactccgcgcccaccaccagaaaatccgtctgcgtgtaccacgggccgatgagaatacgtccctggcggatcagcgcctgtagccggtcgcgctgttcgggggcgacgcgcagatagtcctccagcaccaccgtttgcccgtccagcacaaaggggccgagggtggtgtcctgctccaggcggttcagcaaatcatgcataaagtaatagagcaccatgcgcgagtcgttctcggtgaaataccattcgcgatcccagtgggtgtgctgaattaaatgtacggtcttcatcaggcgtaccttctccttatagatgggacggcctcagcgaccggctttaaatttcggcgcggcggcgacgggtttattttccggttcgttttcactgcgaaagaccagcaacgagccgacggcgataatggccgagccggtggcaatcgacagcacgtataccggccagtgactcaccgccagccagccataaaagccggagatcggcgcatggttgaccgcccccagcccgacggccatcgccgcgctggtggcggagccgagcacgttaatgatgatgattttgggattggcgagcgcaaaggggatcgcgccttcggaaacgccgatcagccccatcagcgttgaagcttttccggcctcgcgcagggacgccgggaagcgcttcgcccacagcagcgtggcgacgccaaggccaatgggcggtacgataatcgccacctgggctgcggtattgggatcgtaaatgcccgaggccagcagcgccatcgccgtggttaccgccgctttgttgaccggcccaccgagatcgaagccgaccatgccgcccaccaccgccgcgaggataattttgttcgcgccggacatcgccagcagccagttttccatgccgtgattaagcgccgccagcggcgtgccgatgataaacgccatcactaaacaggtgagcagcgtgccgcccaccggcaggataaatatcggcccggcggacgctaaagctttgggtaaacgcacccaggtggtcagggcgcgcacgatgtagcctgcgacaaaacccgccgccagcgcccccagaaagccggtgcccagattactggcgagcaggccgccgaccatgccgggagccagccccggcttattggcaatcgcaaaactgatgtagcccgccaccaccggcagcatcagcgataacgccatgccgccaaagccgtcaaacttatgcagcagttgcaccaccacgcttgccgcctcgccatggctggcatcccagatattatcaatgccgtacatagacgcgccgatacgtgcgatgcccatgatcaccgctccggcgatgacaaacggcagcatccaggagacgccggtcataatggcgtttttgatttccgtgcccgccgacgggccgcttcctccgttgaacttagccattggcgtgctcctgctccagcgcttcaaataccgcatcgccaaacttgatcggatcggagacgctgcactccagcttgatcatgccgtcgaagcgttctttgccgctgatggcgacatcggcggcgatgatcacgccatccgcccgcgccaggtcgtctgcggtgatgtcattttcaattcccaggctgccctgggtttcgactttgatttcatggccgcgctgacgcccggtaagctccagcgcttctgctgccatataggtatgagcgatgcctgtcggacaggcggcgacgcaaacaataaacatagaaactccttacagggtcggattcaggcaataaaaaaagcacaatggcgaaggcgcgcattgtgctttgcggggaaaccattaaccggaacgcggcgtcgtctgacgcgccgctggcgtgatgacaggccatcagctggcgcaggctggaaatacggaacaggaaggccagctcgtcgcgtttacggctgtgcagacgggtggcgtatccggcgtgatataaaacttttattaacggcgcggcgggacgataaagtgacgggcagagttttccggcgctggaccataattgcgcccagccgacggcggtattttcatccagcgcgtcatgaataatcgcatcgtctttttcaagggaaggaacagaagtaaaccagcaaattttactcagccacgcacgaacagcgctatcgcaaaatagccctgttaacatgcattgaaatagccgctgaatattaatcactgacatctgcctccgttaaaatatcagcggagtataggtcagcgaattaaacgcgaatgtgattcttcacacagtccacggcgttaaattccgtttttaacgccgtgcattcgctcatcgctcagcgacgctgcccgccatgcggccaaacatcggtttgccggtcagcgtaaaggcggagaggagcgtcaccaccagcacgatgctgccgaggatcagataggtgtcctggaagccaatacggtcatacatatttcccgcaaaagccgacaggaaaatcgccgccatctgtttggcaaagttaaagccaatcagatagatggtggcggacaggcgagtgtcgaacacgccggtgatgtatttaaatgcgccaaccaacaggaacggcacttccagcgcgtgcagcattttcagcgccaccacttccaccacggtggtggcgaaggccgagccgataatacgcgtggtcatgatcgccccggcaatcagcagggtatttttcgcgccgatgcggttaatgatccacggcgagcagaacatgatgatggcgttgcacatttccccggcggtggtcgcaaaaccgaaggcctgggtgcccgcctgcggcgtggcgaagaaagacttaaagaaggtggcaaactgctggtcgaacacgtcatacacgcaggcgacgccaatcacatagaggataaacatccacattttgcgctggcggaacaggctgaagaccattttcgcgctgatttgcggctggttggcccccagcgcattcatcacctgcgcggtctggttttgctgcggtcgggcgataagcagtaacagcatcagcatcagggccgccgccgaacccatccagaatacccattccggattgacgctgaacagcatccccgccgtcgaggcgcacaggccccagccgagacagccgaacattcgcgctttgccatactcaaaatggctgttacggctgacgcgctccacataggcttcgatcgccccggaccctgccgagaagacaaagccgatgtagatcccgccgctcagcgcccccagccagatattggttttcagcagcggcgcgaagacgtagaggaaaaagggggcgaataaaaacagcagtaccgagatcacccacagcaagtttttcttcaggccgagcttatcggagatcacccccagcaccggctgaaaagcgatggcaaacagcgagacgcaggagaagacgatgccggtttctgttttggtcaggccgataatgtcggacaaccagatgggcaaaaacggaaagcaggtcgccataatgaaaaagtagaggaagacgaacaggccaaaaatccagaaattagggttgtttttatgggtacagtcggtggtcttcatgttaatccctcagctacgggccgcgtggcggccctgcatgatcatacgcgttcgaaaccaatcagaatggcgctttccggatccagcaccggtaaggccagccccgccaccttcagccattcgccgctgacggtttgctctgttgtcatccacgccgggagtttgcgcatggtatggccgcccgccccggtcagctgaatattgggatcgtccagcagcctgatgcgataacgcgcgccgctatccagacccggcacccgcaacggcatcatcaggctgtaatccggcatcgccagctggctgaccaggaacagcccttgctgctgatcctgactgaccacgcccaccacctgagtcgtggcatccggcatatccacccgccactggttgccggaatgaatgagcccccgccactgcttatagagcgcggcgtaatggcgatagcctgcgcgttcctcttcaccggcgctcaccggatccagctccagccccatgtgcccgaacagcgccgtcagaccgcgaaaagcaatgctgtgctggcggaaggtagcatgacagtgacgattgccgatgtgcgcacccatcacttccggcgggaagaagtagctcatgccgcgctgaatagtattacgctccagcgcatcgttgttgtcggagggccagaaacggtggcagcgggtcagcacttcataatcaatacgcccaccaccggaggcgcaggactcaaattccacgtgcgggaagcgactgcgcagggcatcgaacagtcgataatactggcgggtttgcgcatcggcggcggctttgccctgatgcgcaggctgcaccagctcgcggttcatgtcccacttcacatagtcgatatcatgctcgcccagcagccagctcatgcgttccagcaggtaatcaaaagcttccgcaatgttcagattcagcaccagctgatggcggccagtggcctgcgggtagccaggcattgccagtacccactccggatgggcacgatagagatcggcattggggttgatcatttccggctcgatccagatgccgaactccatgccgagatttttgacatggtcgataaccggcttcagaccatcggggtatttttgctcgtcgagataccagtcccccagcgccgcgcggtcgtcattgcggcctttgaaccagccatcatcaataataaaccgctcaacgccaagcgccgccgcttcgtccgccatctgcatgatataggccggggagtggttgaaatagatgccttcccaggtgttgaggtgcaccggacgcggcttctcctgcggaaagcggatcagctccccgcgcaggaaatgatgatattgctggctcataccattcagcccggccgctgaatagctggcgtacaaccacggcgtccacagggtatcgccttcggcgagcgccatttctcccggcagatagagcgcctccgcctgcaaatagcgacggccgtcagttttcacttcgcagcgcatacggtggttgccgctccagccgagatgcgcgccccacacctcgccctgcatttcgctgaaggcctggctgccggcaatcagcgccgggaaatgttcgtgagaactgcgcccgcggcggctttccagcacaaagctgtcgtgcgtcagcgtgacgcggtgcggctgaaattcgcggatccagcggccatggaacgccatcacctcctgcgcatgcccggctaccggcaatgtcaccgccaggcgatccacctgccagtttcccgcgcggttattggtcagcccgtggcgaattttcagcacgccgctggccgacagggcaatttcgctgcgcagttgcagacccgcctgcgcgtcttcgctggtgatgatcagcgtctggttatgctgctccacctgagtagtggtaaacaccggggaaccgtcgaggccgttgcggtggccttcaatgcccggcgaaccaaaaaggccatggcccggctccgccatcagcgtgatcggagcgtcgacgtccagttttccattggcgacaggacgttcaagactggctgcgtcctgcggcgaaaagtcggcaagatgcgtgccccagtaaagaatttcggcgaacggacgggttttgattaccacatccacggtggcgctttgcaggcgtaaaatcgacttttccatgcatcatctcctgagtattgatgatgtcatcgttgatccgaaacgtttcggatgccaaccaaaacgattcggatttgtgatcggcgtgggaatttaccgtaaagaaaggtgagtcaggcggtgacgcccggacggaattccggctgccacagtacctgtaatgtggcgagatcgtcaccggcaatcagccgccgtaccattccggcgatctgacggcccacgccctgacgggtggactggatcaccgccgccacgtccaggtcgacaatgctgtcggcgggcagcccgtcgtagacgatcagcgcgacgcggttgtcgcccgtcaagcgtccggcctgcgccagcgccatcgccgcgccgtcgccgtgggtgttgcagtcggtgataatggcagtgggcggctgcggcagcgccagcagttcgcgcgtggcgttatagcctgcccggcgcgacggcggcatgacgcgcagccattcacgggagaggccgctttcattgagcgcgttgagatagccgtttcgccgctgggtgataaaagcctgggtgttgttttcccccagcagcgcaatacgctggtgaccctggtcaatcagatggcgggtggcgcgccaggtaccggcatgattatcgaaatcaaaccaggcgtaaggctcggagagctggctgcggcccagcgccagaaaagggaaacgcgccgcctgcaactgctccagacgcgggtcgttatccagcgtgtgggcgacaatcagcgcgtccacgcggcgactctgcaccatgcgcatatagctgtgcttgtccgccagatcgtcatcggcaatcagcagcaggtcgatttcatgctgcgccagttcatggctgatctcccccaccatatccatgaaaacactgttattaagcggtacgggatgcaccggaaataccagcccgacggcgtcgattttgcccattttcaggcggcgggcgaaggtattgggacgatacccccggcgctgcgcttcagcctccacgcgggcgcgcgtttcctgcgaaacatcgtcataaccgttcagggcgcggctgacggtagttaccgacaggcccagttctttggcgatagcttttaacgacataattttccgtgtcagaggctgaagaatgccgctagtgtcccgcaaccttatcaggccgtccagcctcaaaataagcgcaaaaaaatgcctgcgggtgaaggcaggcattttctggcttacgacaactcagaaatagtatttgaagcgcacgcgcgcgccgtaacgatcgtcgtcgttattgctgctgttatccaccgtgtcgctgtcgagaatggagtagtaggtccccagatagatattaaagttcttcatattcatcacgttcgggatctgataagaagcaaaaatggtgtgaatatcgtaagtgccttcatcaaggacgaagttgtcatcgtcgccgatcacgccgtcataatcggtgattttgttatgggcatagacataacccagctcgaagcgtttccacagggcgttgatcccggcgctgaagtcctgttcatccgtggcgtccatgtaggcgctggtcaggttcaccaccacgccgttttccggatcggttttcagcccgtcccaggccatacgcagaccataaccggtgcggtcagactgatcgacaaattcaccctggctattagtgtaaccgtaggcgttattcaccacgttggtttccacggctgccgcaaaggtaagttcatcctgcgaccaggcaatcaccgggcgcagataggcgacgtttttctgctgttccatttcacggccatgatagagcctgccgtcaccatcatcgttatacagcgaggtgccatcttccagcagcgtgttcagctcgaaataccagttgtcgatctgcttgctcatcataaagctaccgcccgcatcggaacgtccgcgaccctctttcatcatatagatgtagccgctggtgtcgtcgtagaggtcgttggcggtattaccggaatgctcaacaaaggtatcctgattgagcgggaacatgtcgaaggcttcgaagcgcccgaccttcactttccagtcattttcctgaccaaagaagaaaacggcgtcatcaagatccatggagccggtcatgtctgccagcggctgggcggagaaaccggcgaaatagccgttatccattttccgcatgccgtcaaaacccaccagaatacggccattcaggtcccattgttcattggtgggatcgttgacgttggcattggtcatcgccaccaggccatgtttactttcggcatccatgttgaattccacgtcgccgtaaactttgatatcgccatagccggacagcaccaggttcggcgtggcggcattgtttttcagatcctccgccggttgttggccgtttaccggcgtgttgccctgcgccgctttaagttcgttaatttccgccgcctgctgcgtttttaattgctgcacctggctttctgccgccgccgcgcggttttccgctgccgccagacgttcttcaagctgctgtaaacgcgcttcaatactgctggtgctggtttttgcccagcccgaacccgcaaccatacttaaccctatcgccactgccaggagtgttttcttcattatttgcattccttgaaataaagtagagttcggtgttgctgtaataagcaacgccgtgaggtaatggatatttgcgatgaataatattttttatttattgattaaaacgaagcatagaattaatgaatatacttaccactattcctgttccgtaatattatcaatacaggcgcgaaaaatagtatgcccgcaccatgctgatgtaaacgcttacaatataaggatcgtgagcgggataacataagccgtaaaattgcaatactgcccggcgataactcatatgacagctaaataaatactaagttatttatcagactgctccggcaattatttatttttaatatggtcgggctaattaaaggaagcagtaactattcgggaaattaataatctctgtgatcagcgaacggataaataaactgtgccccttcccgcaaatttacctttttgctgcatgaaatatgtcatgcccggcggacatatctccgctcagcgccctgcccgcggccccttacaatcaggtgaacgagatcaacggagtgaaaagatggcgcacctcaccgcagactgcatcaacctcaacatcagcggcaacagcgcctattcggtgctgaaagcgctggcggatatggccgaaaaacagggagttatcaccgatcgcaacgcctttttacaaaccctgctgctgcgcgaaaaaatgcactccacgggctttggcgcgggcattgcagtgccgcacggcaaaagcgcctgcgtcacgcggcctttcgtgctctttgcccgcaaagcgcagggcgtcgactggcaggccagcgatgacgaacccgtaaactgctggatttgcctcggcgtgccgcaggctggggaagaggatcaggtgaaaatgatcggcaccctgtgccgcaaactcattcacgcggattttatcgcacagctcaaacagggcgacagcagccagatcctcacgctgcttaatcagaccctgggtgaataaggagccttccatggagacatcgttacgcctggtggcgatcaccaactgccctgccgggattgcgcacacatacatggtggcggaagcgctggagcagaaagcccgcgcccttggccacagtatgcaggtggagacccagggtgccagcggcgtggaaaaccgtctcagcgatgaggctattcgcgcggcggattacgtcattattgccaccggacgcggcctgagcgccgacgatcgtgcgcgcttcgcgggcaagcgggtgtaccagatccctatctcgcaggcgctcaaaaatatcgaccagatctttaccgacttaccggcgcaatcgcagcttttcgaagcggatagcagcgtgaagcttggcaaacaggaggtgcagcagggcagcgtgatgagccacctgatggcgggtgtttctgccgcgctgccctttgtgatcggcggcggtattctggtcgccatcgctaatatgctggtgcagatggggctgccctataccgatatggcgaaaggcgcaccctcttttacctgggtggtggaatccatcggctatctgggctttacctttatgatcccggtgatgggggcctatatcgccgcctctatcgccgacaaacccgccttcgcccccgcgtttctggtctgctatctggcgaatgataaaggcctgctgggcacgcagtccggcgcgggttttctcggcgcggtggtgctggggctggcgataggctatttcgtactgtggttccgcaaagttaagctcggcaaggcgttacagccgctgctcggctcaatgcttatccctttcatcacgctgctggttttcggcgtgctgacctattacgtggtcggcccggtgatgtccgacatcatgggcggcctgctgcatttcctgaataccattccgccgtcgatgaagcttggcgcggcctttctggtgggcgcgatgctggcgttcgacatgggcgggccgatcaacaaaaccgcgtggttcttctgcttttcgctgctggaaaaacacatttatgactggtacgccatagtcggcgtggtggcgctgatgccgcccgtcgcggcgggcattgccacttatctcgcgccaaaactgtttaccacgcaggaaaaagccgccgccagtagcgccatcgtggtgggcgccaccgtcgccaccgaaccggccattccctatgcgctggccgcgccgctgccgatgattactgccaatacgatctccggcggcattaccggcatgctggtgatcggcttcgggctgcaacgcctcgcgccggggctgggggtgtttgatccgctgattggcctgatgtctccggcgggctccttttacctggtgctgggatgcgggttgatgctgaatatcgtgctgatcattttattgaaaggattgtggctgaaacgtaaagccgcgcgacaggaggttgcccgtgaacactgaattactgaaaaacctgtgcgaagccagcgccgtcagcggcgatgagcaggaagtgcggcagctactgatcgccgcgctgacgccccacgtcgatgacatcgcctttgacgggctgggcagcctgatcgcccgcaaaggcacgcgcggcccgaaagtggcggtggtcggccatatggatgaagtcggttttatggtgacccatatcagcgagcagggatttatccgcttcgacactatcggcagctggtggagccagtcgatgctcaatcatcgcgtcaccatccgcacccgccacggcgagaaaatccccggcgtgatcggctccgtcgccccccacgcgctctctgaaaaacagaagcagcagccgctgacctttgacgagatgttcattgatatcggagcggcaagcggcaatgaggtaaaaagccgcggcatcgccattggcgattttatctgcccggaggcgaatttcgcccgctggggcgaggacaaaatcgtcggcaaagcgctggataaccgcgcgggctgcgcgctgatggcggaactgctggcctgcgtgaataacccggacatcacgctgtacggcgtcggcagcgtcgaagaagaggttggcctgcgcggggcgcaaacctcggcagaatgcatcaaaccggatgtggtgatcgttctggataccgccgtggcgggagatgtgccggggatcgacagcatcaaatacccgctgcggctgggggatggcccggcgatgatgctgttcgataagcgctattttccgaaccagaaactggtgcaggcagtaaaagcgagcgcgatgcgcagcaatacgccgcttcagtgctgcaccatgaaaaccggagcgacggacggcggacgctataacgtgatgggcggcgggcggcccgtggtggcgctctgtctgccgacgcgctatctgcatgccaccagcggcatgatatccgcgcgggattacgccgccaccctgacgctggtgcgcgatctgctgttatcgctgaatgccgaaaccgtccgcgcgctggcggattttcactgagaacgcctgatgctcaacgaacgccagcttgccgtgctggaacatctggaaaaccagccgctgacgctggcggaactggcgcggcgggcaggcgtgtcgacgcgtacgctgttacgcgatgtggattaccttaatctgacgctcagcggccgggcgcgcctcgtcaccaccggtaacgccacctggcagctggaaattttcgatcgcgccagctatttccggctgttgcagcgccacgacaacgacgatcgtctgctggcggtgctgctgcttaacgcctgtaccacccgccgccagctggcggaggcgcttaacctgccggaaacctggatcggcgataagctggcgcgtctgaaacagcgctgtgaaaagcgctttaccatcgccgcacgtcccggcgcgggctattttattgcggagccggaaatgaagcgggtgctaattctcgccagcctgctgaaaaaagatcccgctctgctggcgctgcatggccgcttttccactgcgggcgacgcggtggcgctggcggcgtaccctgatattccccgcgattatctctccggcataattctggcggtgtatgccctgcgccaccggctcgacgccccgccgcccgtcggcgtcagcgatgcgctcgccgcctctgtcaacgctatgggcctgtcgctgcatctgcctgcgctgcaaaccctgacagctattctggatacgctgcaatcccgcgccagtaaactcactccgcagcgcattgcagcattgctggagcaggtgcgcgataaccatccgcccgccattatcgacgccacgctgattgacaatcttaccgggcatttaattcgctgcgccgccacgccggtgtggttgacggaaagccgccagagcagccttaacacgctcaaagccgcctggcccgccgcctttgatatgagcatccgctttatcgccctgctacgcgaacagctggacgtgacggtgttcgacagcgatcttatcggcctctattttgcctgtagcctggagcgcaaccagaccgaacgccagccactggtcctgttatccgatcagaacgccatcgccaccatcaacaagatggccatcgagcgcgaggtgctgaactgccgggtggtgatcgcccgcagcctgagtgaagcagacgagttgctgcacagcctgtcgccggtgtgcattatcaacaacagccattttcgccctgacgacagcttcaaaaactgtctgaccctcaaaaacatgatcgggcctgcggggatcgcgcaaataaaagacgtggtggaaacggcgttcatccgccagaacctcaaccggctgtttccgtcgcagggcagttttcattatgtgaatacgccgtcgcaaagctggagcgcgatcatgcaggcggtatgcgggcgactcagggcggcggcgcgcataagcgaagatgaagcggtgcggctgtgtgaacgtgagcaggagggcgagaatttgatcgtcaatcagcttgccgttccccactgctggagcgagcatcgggcggctttttgcggctattttattacgctggcccatccggtcatcattaatcacgagccggtggcgcatatgctgattgcctgtgcgagcgcaacggcgcgacaggagctgaaaatttttagttttctggcaagcgtgatgcatcgttatccggcacagcggatcgcggcattagcgggttatgaggagtttatggcgttgatgcaggcgtaatacggggcgggaagcccgtccccgctcagcagagcagggacagcagctttgggacttatttattcagttcggcggtcatgtggatctggttaccggtgtaagcttcggtaattttgtaagacgatgcgccagcctgttgcgctttagccgcgatttgcgcttctgcaccggacagcgtggtggcggtggcggtcactgactgggcagcgaaagcaccgaaagaagcggtaagagcggcaactgcaactaaagttttgatgtttttcatgatgactatccttcaggttaatttgttgggataaggcgtctcgccttgatgtgataaatactagacctgtttatccccaacgaatagcggaaggatttgccgataaacttcaaaatttttgacgttcttttcagaggcctttcaggcgctgcggatgggtgtaaatcgtcgccctgcccggcttgcaaaatcccaccagcgtcagattgcagcgctccgcgacctcaaccgccagcgtggtcgccgcggagacggcaaagaggatctcaatgccgcacatggcggatttctgcaccatttcatagctggcacgactggaaaccagcgccgcgcctggccgccaggcttcaccttcctgcgcccgacgcccgagcagtttgtccagcgccacatgccgccccacatcttcatgcccgcccgccagttccccggacggcagcagccaggccgccgcatgggtacagccggtcagtttgcccaccggctggaaatcggtgagatggcgcagggcgtcatccagcagggcaagatcaaaggtctgggtaaagggcagcggcgcgaccggcttgccgatgtcattgagctgctccacgccgcacacgccgcagccggtgcgcccggccagcgcccgacgacgctccttcagccccataaagcggcggctggagagttcgatttgcacttccagaccgttgcagaccggcaccacgtccatgccgtagatctcgttcggcgcctcaataatcccttccgataacgaaaagccgagggcgaacagcggcagatctttgggcgaggccatcatcaccacgtgggagatgccattatataccagcgcgacgggcacctcttctgccagcacgtcgggctgtgaatgatgcaaatcctcacgcttccacagcgcgacggatcgggatccgatgagagcagtcacattttcctcttaatttacggcacaaattgttcactaattgttaaccaagccggaacaggcctaattacaatgtggtattcttccggtaatccccgcctcaaaacaggggatcccgtaattctgaacctttgcggcgcctgccgcaaagtataagtacgtgagtaaatgtcgaaataacgaaggagtgaccatgcaggtcagcagaaggcagttctttaagatctgcgctggcggtatggcaggcacgacggcagcagcgctgggctttgcccctggcgtagcgctggcggaaacgcggcagtataaactgttgcgcacccgcgaaacccgaaacacctgcacatattgctctgtcggctgtgggctgttgatgtacagcctcggcgacggcgcgaaaaacgcgaaagcttccattttccatatcgaaggcgacccggatcatccggtaaaccgcggcgcactgtgcccgaaaggcgcaggtctggtggactttatccactccgaatcgcgcctgaaatatccggaatatcgcgcaccaggttctgataaatggcagcgtatcagctgggaagaggcgtttgatcgcatcgctaagctgatgaaagaagatcgtgatgccaactatattgcgaaaaacgcagaaggcaccaccgtcaaccgttggctctcgaccggtatgctttgcgcatccgccgccagcaacgaaaccggctatttatcccagaaatttacccgcgcactcggcatgttagccgtcgataaccaggcgcgtgtctgacacggaccaacggtagcaagtcttgctccaacatttggtcgcggtgcgatgaccaaccactgggtcgacatgaagaacgccaacctcatcgtggtgatgggtggaaatgcggcagaagcgcatccggtgggattccgctgggcgatggaagccaaaatccataacggcgcgaagctgattgtgattgatccgcgctttacgcgcacggcctcggtcgccgatttctatgcaccgatccgccccggtactgacatcgccttcctgtcaggcgtgatcctgtacctgctgaacaacgaaaaatacaaccgcgaatataccgaagcctataccaacgccagcctgatcgtgcgtgaagatttcggcttcgacgatggcctgtttaccggttatgacccggaaaaacgccagtacgaccgcgcgacctggaactacgagctggatgaacgcggctttgcgaaacgcgacaccacgctgacgcatccgcgctgcgtatggaacatgatgaaaaaacacgtctcccgctacacgccggacgtggttgaaaacatctgcggtacgccaaaagccgacttcctgaaagtctgcgaatacattgcggaaaccagcgcgcacgataagaccgcctccttcctgtatgccctcggctggacgcaacactccgtcggcgcgcagaacatccgtacgatggcgatgatccagctgctgctcggcaacatggggatggcaggcggcggcgttaacgctctgcgcggtcactccaacattcagggtctgaccgacctcggcttgttgacgcaaagcctgccgggttacatgacgctgccgaatgataaacaagccgatctgcaaacttatctggcgggtaacaccaccaaaccgctgctggaaaatcaggtcaactactggagcaactacccgaaattcttcgtctcgctgatgaaggccttctatggcgacaaagcgacggcagagaacaactggggctttgactggttgccgaagtgggataaaggctacgacgttctgcaatatttcgagatgatgaacgagggcaaggtcaacggctatctttgccagggctttaacccggtcgcctctttccctaataaaaacaaagtgatcgcgtcgctgtcgaaactgaaattcctggtgactatcgatccgctgaacaccgaaacctctactttctggcagaaccacggtgagcagaacgatgtggatccgtccaccattcagaccgaagtgttccgtctgccgtccacctgcttcgcggaagaaaacggctctatcgttaactccggtcgctggctgcaatggcactggaaaggcgcggacgcccccggcgaagcgttgaatgacggcgagatcctggcgggtattttcatgcgtctgcgcaagatgtacgccgcagaaggcggggcgaatccggaacaggtgctgaacatgtcctggaactacctgacgccggaaaacccgtcggcggaagaagtggccatggaaagcaacggcaaagcgctggcggatattatcgatccggtcaccggcgatgtgctggcgaaaaaaggcaaccagttgagttcctttgcgcacctgcgtgacgatggcaccacctccagcggctgctggatcttcgccggtagctggacgccggatggcaaccagatggcgcgccgcgataacgccgatccatcgggcctcggcaatacgctgggctgggcatgggcgtggccgctgaaccgccgcatcctgtataaccgcgcctccgcggacccgcagggtaaaccctgggatccgaaacgccagctgttgtcttatgccaacggcaagtgggtcggggccgatattccggactacaacaccgcgccgccgggcagcgatgtgggcccgtttatcatgttgcaggaaggtgtgggccgtctgttcgcgatggacaaaatggccgaaggtccgttcccggaacactacgagccgtttgaaacgccgctgggcactaacccgttgcacccgaaagtgatttctaacccggccgcccgtatctttaaaggcgacgcggatgcgttaggaaaagcggataagttcccgtatgtcggcaccacgtaccgtctgaccgagcatttccactactggaccaagcacgcattgctgaatgccattgcgcagccggagcagttcgtggagatcggcgagaaactggcgggcaagctgggcatcgcccagggcgataccgtgcgcgtctcttctaaccgtggctatatcaaagccaaagcggtggtgacgaaacgtattcgtaccctgaacgtgaacggtcagcaggtcgacaccatcggcatcccgatccactggggttatcagggcgtggcgaagaaaggctttatcgccaacacgctgacgccgtttgtcggtgatgcaaacacgcaaacgccggagtttaaggcgttcctggtgaacgtggaaaaggtgtaacggagacgacttatggcttatcaatcgcaagatattatccgtcgttccgcgaccaacggtttcacccctgcgcctcaggcgcgggatcaccagcttgaagtggcgaagctcatcgacgtgaccacctgcatcggctgtaaagcctgtcaggtggcctgttcggagtggaacgacatccgtgatgaagtgggacacaacgtcggggtgtatgacaacccggcggatctgaccgctaaatcctggacggtgatgcgcttctcggaagtggagcaaaacgacaaactggagtggctgatccgtaaggacggctgcatgcactgcgccgatcctggctgtctgaaagcctgcccgtctgaaggggcgatcattcagtacgccaacggcatcgtcgatttccagtcggaacagtgtatcggctgcggctactgcattgcaggctgtccgtttgacgtaccgcgcatgaacccggaagacaatcgcgtctacaaatgcaccctgtgcgtggaccgcgtgactgtcggccaggagccggcatgcgtgaaaacctgcccgaccggggctatccactttggttctaaagaggatatgaaaaacctggcgggcgagcgtgtggccgagctgaaaacgcgcggctacgacaatgcaggcctgtacgatccggcaggcgttggcggtacgcacgtgatgtacgttctgcaccacgctgataaaccgaatctttaccatggcctgccggagaacccggaaatcagcgccacggtgaaattctggaaaggcatctggaaaccgctcgcggctgtcggctttgcggcaaccttcgcggccagcatcttccactacgtcggtgtcggtccgaaccgcgcagaggaagaggatgacaacctgcatgaagagaaagacgaggtgcgcaaatgagaaaacgtgacaccatcgtgcgctacaccgcgccggaacgcattaaccactgggtcaccgccttctgcttcgtgctggcgtcggtgagcgggctgggctttttcttcccgtcctttaactggctgatgcatattctcggtacgccgcagctggcgcgcatcctgcaccccttcgtgggtgtggtgatgtttgcctcttttatcatcatgtttttccgctactggcatcataaccttatcaatcgcgacgatattttctgggcgaagaacattcgcaagatcatcgttaacgacgaggtgggcgataccgggcgttataatttcggccagaaatgcgtgttctgggcggcaattattttgctggtgctgctgctggttagcggggtgattatctggcgtccgtacttcgcgccggtcttctccattccggtgatccgatttgccttaatgctgcattcatttgccgcagtagggttaattgtggttatcatggtgcatatctacgccgccctatgggttaaaggcaccataaccgcgatggtggaaggctgggtaaccagcacgtgggcaaagaaacatcacccgcgctggtaccgtgaagtccgccagaaagaggataagtcacctgaatgagtattcgcataatcccgcaagatgagctggaaaaaagcgagaaacgcgcggcggatatgatcccgccgctgcttttccccaggctcaaaaatctctataaccgccgtgctgagcggctgcgtcaactggcggaaagcaatccgcttggcgattatctgcgctttgccgcgctgatcgcccacgcgcaggaagtggtgttgtacgaccatccgttacagatggatcttaccgcccgcatcaaagaagccaacgaccagggcaagccgccgctggatattcatgtcctgccgcgcgatacgcactggcataagctgctgcattcgctgatcgccgaactgaaaccggagatgagcggtacggcgctggcggtgatagagaatctggaaaaagcctcgtcccaggagcttgaggcgatggccagcgcgctctttgcgacggattttgcctccgtcagcagcgataaagcgccctttatctgggcagcgttatcactgtactgggcgcagatggccagcctgatccccggcaaagcccgcgcggaatatggcgaacagcgccagttctgcccggtgtgcggctcgatcccggtttccagcatggtacatatcggcaccacccaggggctgcgttatctgcactgcaacctgtgtgaaaccgagtggcatgtggtgcgcgtgaagtgcagcaactgcgagcaaacgcgcgatctgcattactggtcgctggacagcgagcagtcggccatcaaaaccgaaacctgcggggattgcggtacttacctgaaaattctgtatcaggaaaaagacccgaacgtcgaaccggtggcagacgatctggcctcgctggtgctggacgcgcgcatggagcaggaaggctttgcccgcagctccatcaacccgttcctgttcccgggtgaaggtgagtaaatagccgtagttataaaagcccgccctgtgcgggcttttttattgcgttcgcgctgctttgcgaggcgctttcagaaatcgtgatcacacttttacatcccttacgcatccggctataacgctgtggattgggagcgtggcgtggtggattttccatgcgatcgttccggtttaagacccggagtgctatcttgtgttaatagataacacaggaggaaaaaatgcccagaacaaccagcataacgattggggaccatttagatcgttttattagcgagatgattgaaagcgggcgttatggttcaacaagcgaagtcgtgcgttccgcgttacgtttgctggaagaacaggagttacacaatggtaagttacgcgaagcgctggaaaagggacttaacagtggggaaagcccgttaactttgcaggaaattgcgacaaggaaaaaacgcagcttaaatgtataaactctccaggctggccgccgaggattttggtgcgatttatgaatattcctggcgtcaatttggcccattgcaggcagataaatacaccgctgaactggatacgtttctaatgctactcgctcaaaaccctttgatggggcgcgagataaatattattgaagatgttcgtcgctacgatcacggtcagcacgccattttttatcagatgcagaatgacgggatttttattgcccgcattctgcatcaacaaatggaccctttaaagcatctgaaatgagccctactcttcttcgttaccgccctcttccagcggtccgaagggtttggcgggcagcacgatatagatgccttcaaaaatcgcgcccgctttatcgtcgccaaagagctcgacctggagctgaacgcgggatttacgaccacgggccaggcggtccagatcgccgctgagcgagcctaaatccgcaaccgcgctcgggcgtccgctgatcggctggctgtaacgaatatgcgcatccgccagaataatggtgccgcccagatgacgctcgcgcagcatcagccagatcagcccccagccggtgagcgtggcaagtgagaacagactgcctgcaaacagcgtgttatgcgggttctgattgcccgtctccggcatggtggtaataaatttttgcccggtgtactgctggatgcgcacgcccattttttcactgagcggaatatgctgataccaggcctgctgcaactgcccgcaccagtcgccgcgatgcagaatatcatcgagcgaagcgacgggtttcaccatcaaaaaatggcgcagcggcgtggtctgcggcgcggtgatctcgccttcgttcacaaagccgagcttggcgaaaaactccacggcgtcttcccgcgcgctacaggtgacgcgctttacgccctcctgccgggccacggattccagcgtcatcgccatcagcgtgccaaggcctttgtcctgcacgctgggatgtaccgccataaagcggatcgaggcttcattgtcggcattgatatacagtcgcccgacggccaccagcttgccgtcttcgtccatcaccatctggtgatgcgccatcgcatcccaggcatcgcgctcggagccgcgcggctggcgcagcggcttacgcagcatttcccagcgaaaggcgtagtaacgttctaattcttcttctgtctgcggtacgcgtaggtggtacatagcggtattctctcttgttgaccggggcaacaccgcaagctgactcatacctggagccagaacgttacggggccgtcattcaccagcgaaacctgcatatcggcagcgaatcgtccggtttgcgtcaccatatcgaggctgcggcaacgcgacacgaaatagtcatacagcgcttcggcacgctcaggttcagcgccttttgagaaccccggacgcatgccgcggctggtatcggccgcgagggtgaactgcgacaccaccagcacgctgccgccagcctgtttaacgttgaggttcatcttgccgtcagcgtcgctgaacacacgatagccgagcacccgttcgcacaggcggtcggctttttgctcgtcgtcatccttttcgacacctaataacaccaaaagtcccgggccgatttcacccgtcacttcatcctccacgctgacgctggcgcggctaacacgttgaatcaatgcaatcatggttggtctgcttgtgcttcttctgcggcttctttgagtttgcggtattccccgagagtgacagttatttccgcgccaagcaagacgatacaccacgtccagtacacccagaggaataaaatcggcaccactgccagcacgccgtaaatcagctgataagaggggaacatggtgatgtagagggcaaaagcttttttgcccagctcaaataacagagcggcgaccagcgcgccgacaagggcatcgcggttcggtacgcgcgtggtcggcacgatgctgtacagcagccagaacgacagccaggagaggatcagcgggaaaatccgcagcacgtcgtcaatcacgctgtcgagatcgctcacccagcgcagggagagcagataggaactgatagccaggctcgcgcccgccagcagcggccccagcgtcaggatcatccagtacaccgcgaaggagtaaaccttcggccgtacccgtttactgcgccagatgacattaagcgcgctgtcaatggcatacattaacagtaaagaggtgacgatcagcccgcatgcccccaccgccgtcattttgctggagttagcgacaaactgttcgatataacgctggatcacatcgccggtggcgggcatgaagttggcaaaaacaaaatgccgcaactggatactgacgtcattgaacatgggaaaggcggcgaaaagcgcgaaaatcaccgccaccagcggcaccagcgagagcagggacacataggcgagattccccgccagcgtcgtcatattgtcttcatcaatacgctgccagagcaatttgagccaggccaccaccggtcgggtatgatgcctggctttatgatgaacggtttttaacataactgcttcgcaaaataggtcgggagagtgtctttaccggtcaccagaatggaggtgatccccagctggttagcgccttctatattatcggcgttatcgtcaaaaaagaccgtatcggcggcgctaaatccttcggcctgtaacaccgcctgataaattcgtgcttcgggtttacgcatccccatatcctgggacaggtaaatatgatcggcggcagctttaatttccggatattcctccggccagaaagtcgtgtgcagacgattggtgttggacagcaccaccacgcggtgcccctgggcgcgcagtttatgcatgatgtcgatcacctccgggcgcagcgcaacaaacaccgcctgccagccgtgggaaaattgctcgtagctgagggggagatccatttcccggcacagcgcttcggcaaaggcttcatcggtgatctccccgcgctcatgctgatggaaagcctcgcccatggtgaagctctgcttgagcgtcgccagcggcacccggctgaaatcgctccatgcgcccagcacccgattgaagtcaatatcgacaatcacattacctaaatcaaagatatagagcatttccctctccttatcagccgtggaaggataactgtagcgggaaatgatgagggtgaacagtcgggcagtgcgggatcgatatatcaggcaagttaactgtgttttcgtgcattgcgccgggtggcggcttcgccttacccggcctacagcatcgatgatactcgtaggcccggcaagcctgcgccgccgggcagagaagaaacgaattattgcatctttaaaacggcagtcgcgtactgccgcgcggcacgatctcaaatcccgcgtcgacgatatcgccctgccagctgcggtcggcgctcatacgcagcatcatttccgcggtgcgggcggcaataatgctggcgttgaggttcacgctggaaagggtcaccggcgacagccaggcgctggaggggaaatccccgtagccaagaatactcagcttttcgggtacggcgatgccgcggctttgcgcttccatcagcagcgcggtggcaatggcatcgctggtacaaaaaatgccgtccagcccgcgcgttttcaccagcgtcgggataaggatttcccggctggcctgccagatattttccgcacggggaatatccaccagcagggcgcttttcccctgctcttccagcgcgcggctgaaaccggcgtagcgaattcgcgcccgaatatcatcctcaaagcgggtggtgaaatacgccagctcctgacagccggaatccagcagaaaacgtgccgccgcatagccaatttcggtgtgattattgccgacctgcgccgggaacgcgccgccgtccacctgccacatctgcaccaccggcacgccgctgttgcgcagcatcttcagcgttgacggtttatggtctgccccggcaatggcgatcaccgccggggaccattgcagaatcgagcggatctgttcttcttctttatcaaggctgtgatcgtgggaggcgatggacagctgaaacccctgcgcgctcaccgtcgattcaatgcgctgcaccacgtggctgaaaaaactgttcgccagcgacggcagcacaatcgccatattgctgctctgtccgccggtaaactggctggcgattttgttgtgcacgtagcccaggctgtcgatagccgactgaatttttttgccggttttttccgacacgcgatcgggctggcggatataaagcgaaaccgtggagggcgagacgccagccttcccggcgacatcatcaagttttacgatttggcgtgatctctggcgcattccactcccgtcttcttatttcgcgttaacagccgcatcagcagcaacgccccggcccagacagccgtaagccaccagacgaaactgtcagggatccccgtttccgcggcaagaccgagcggggataaggtcataaatatgctgattaaaacggccatcatgataacacttgccgggatggcataacgccatttttccattggtattctggcgggcgccgcctccggctcctcccagcgcgcaggccacagatatcccatcagcaacaggatcgccagttcaataacgaacagcagtcccatcacgtggatatagtgcagcggaataaatttttgcaccccgctgaaggtatagatcgcataaacaacaatatgaaaaatcagcactgtttttgccgctcgcgccggtacgttgcgcgttaaaaatcccgccagcaccagagtgatgatcgggatgttataaaagccggtaaagcggcgcatcaaatcaaagatgccgttcggcgtatgcagcagcaacggggccagcacaatagacaccagcgaaaacgccagcgaggcgattttccccacccgcaccagttttgcctcgtcctgacagccggtgagggggccatagagatcgataacaaacagcgtggcgctggcgttaataatcgaattgaaatggctgatcaccgtgccgaaaatggcggcggtgaacatgcccgtcagccaccatggcagcagcgctttgaccagcgccggatacgcataatccgcattgctgaacaccgggccaaacagattgaaggcgatcagccccggcagcaccatcaccagcggcaccagcagtttgatactgcccgccagcagcacccccttctgactttcggccagtgacgacgcgcccagcgtgcgctgaatgatcatctgattagtacaccagtagaacatattggcgcacagcatcccggtaaataccgtactaaacggcacggacgcggtttcactgccgatggcgttcagctgcgccggatggttcagcaggcgcgttgccccgctgataaaagcgccgtcgcccagcgcgaacagccccagtacggggatcagcagcgcggcgatcagcaaaatcacaccgctgatagtgtcggagatggccaccgctttcaggccgcccagggtggcgtacagcccgccaattgcccccatcgccagtgccagcaggccaatggcgctccaggcgggcagatgaaagaatgactgaaaatcaaagatttcgttcatggtgagcgcccccagatagaggctgcacgggttcgccatcaccgcatagcccaccagcagcataatgctcaccatccgccgggtcgtctgatcaaagcgcgtttccagaaattgcggcagcgtggtcagtccgcgacgcaaaaagcgcggcagaaaaaacagcgccatgatgatggtcgccacggcagcggtgctttcccaggccatgccgctgatatcaaagcgatacgcattgccgttcagccccaccagttgctccgccgacaaattagacagcagcagcgatccggcaatgaaataccccgacaacccccgcccggcgagaaaaaagccgtccacacccgcttctgaaatgcctttggttttgcggtatgagtatagcgctacgaaaattaagaaaagtaaaaacgacgcgacagaaaatagcatctgcataacaccaccctccctgagcatgcggttccattactattccacagcctttccccgacagataacgacaacagacgggaaatttgagctggcctgtcaaaaaccatactcacggcaagggaattgcgggggctatcacaaaacagggctaagccatcttgaatatcgtagcgctacgatattaccgtataaataaacctacaccggagtacttacatgatgttcaacacagatcgcttaccacgccgtgagatcggtgaactccgcagccagcgctggtacgcccccgataccatccgggcgtttgcccaccgccagcgcacacaacaaatgggatttggccgggacgagtttctcggtaagccggtcatcggcattatcaatacctggagcgacatgagcgcctgccatgcgcatttacgcgagcgggctgaagccgtgaagcgcggcgtctgggcggcgggcggttttccggtggagctgcctgcgctgtcgatgggcgaagtgatggtgaaacccaccaccatgctgtaccgcaatttcctggcgatggaaacggaagagctgctgcgccagcatccgatcgacggcgtggtgctgctcggcggctgcgataaatccacccccgcgctgctgatgggcgcgctgtcgatggatttgccgctgatcttctgccccgccgggccgatgaccaccggcaaatggcgcggccagaccacaggcgcgggaacgcacaccaaaaaatactgggatcagctgcgcctcggcgccattacgcagcatgactgggtggagctggaaggggcgatgacgcgctccatcggcacctgcaacaccatgggcaccgcgtcaaccatgacctccattgccgatgccatgggttttacgctgccgggtgccagttccattccggcggcggacagccgtcatccgcaaatggcggcgcagtgcggccaggccattgtcgatatggtgtggtacgaccataaaccgtcccactggctgacgaaaaagaatttcctgaacggcatcgtcacctatatggcgctgggcggctccaccaatgcggcgatccacctcattgccatggcgaaccgtgccgctattccgctgacgctcgccgatatggaagccatcgcccgccgggtgccggtgctcgccaacctgttcccgtcgggaaaatacctgatggaggattttttcttcgcgggcggcctgctggcgcagctgaaaaagctcaccggtttcttgcatctggatgcgcggggcgtcaccaaccggccggtcagcgcgtggatcgaacaggcgcactgctatgacgacgacgtgatccgcgatctgcaaaatccggtcattccgctgtcacagggctgcgcactgacggtgctgcgcggcaatttatgcccggatggcgcggtgatgaaatcctccgccgccagcccgcagctgcgcaaacacaccggtcctgcgctggtgttcgacagccatcaggcgctgtcggatcagattgacgaccccgatctggcggtcactaaagatacggtgattatcctgcgcaatgccgggccggtgggcgcgccgggcatgcccgagtggggcaacctgccgatccccaaaaaactgctacgcgagggcgtgaccgacatggtgcgtatttccgatgcgcggatgtccggcacccattacggcacctgcattctgcacgtcgcgccggaagcggcggtcggcgggccgctggcactggtgcaaaccggcgatcgggtgacgctcgatattgaggcgggcacgctcaatatgctggtggacgacgacgaaatagcccgccgccgcgcggcacttaccccgcagcacactgtttttgcgcgctcctgggcggcgctataccaacagcacgttacccaggcgaatgaaggctgcgattttgattttctgcaatccggcggcgatgtccctgaaccgcccattttttaaggaaccctgatgaacccttttaaacacgccctgctttcaggccagcgcctgctcggcacctggatgatgaccggcagcgataccgtcgccgaagcaatggcgacggtcggattcgattttctggtgctggatcaggaacatgtcgccgtcgatacgctggacgccatacgcattgatcgggcgatccgcagcatcagcgccaccaccacgccgctttaccgcctcgcgggaaacgaggtggtgcttattaaacgcgcgctcgacggcagcgcgatgtcgctgatgatcccttttatcaacaccgcggaagaggcgcagcaggcggtggtcgccgcttattacccaccgtatggcaaacgcggctttgccgccatgcaccgcgcctctggttggggcgggaatgcgcagtttgtgcaggaggcgcgggacgaactgtgcctgatcctgcaactggagacgccggaagccatcgccagtatcgatgccatcgctcaggtggacggcattaccggcttctttatcgggccgggcgatttgtcagcggcgatggggcagccgggcaacccgtcgcacccggaggtgcagctgatgatcaagcgcgggctggaggtctgtcagcgcctcggcaaaccctgcggcatcgtcggtggcaatccgcaactggtgaataagtaccagcagatgggctttaactttgtggcgctggcctcggacatgagctttatgctggcgcgcgcgaaagagcagctggcggccattcgcggagaacagctcaccattcgcggcggggaggtgtactgatgacccggcttattgaaggtaaatacggcgatatgcatatcgccgtcgcgccggagttgggcggtgcgcttgcctggctgcgctggcgcgggcacaacattctgcgccctctcgatccgcggggcgcacagcgcgccaatatgtgcggcagttatccgctgatcccctggtcgaaccgcattgccgacgggcgcttcgcctttgacggccagccttttcaggtgacgcgcaacgtgccggataatccgcacgcgctgcacggcatcggctggcagcaaatctgggaggtgatctacgcgagtgaaacgcagattgatcttgcgtttacctgcccggcctctgtccgctggccatggccgtggcgggccagccagcgttttgcactgaccgaaaatgacctcagcgtgtcgctgacgtatcacaacctcgcggatcaggctgtgcccgccgggctgggctttcacccgttttttgccgacgccgcccgcagcgaggtcatgtttcacgccgcccacgtctggctgaacgatgaaaacagcctgccggatgaggaagtcgccgtgccgcccgcgtgggactacacgcgctttaaaacgccgctcgccggctcggtagacaactgttttaccgactggaacggcgaagcgatcgtgtgctggccgcagcgcggcatccgcgccaccttgcacagcaacacgccgaatctggtgttttttattcccggcgacgggcgcaacgtggtggcgatggaacccgtcagccatatcaacgacgccattaaccgcttcccggcaggcagcaacgtccaggcaatggatcgcatcgcgcccggcggcgagctgtcgctcagcatgacaataaggatgtcagacgatggaacaaccccgcgtactctttgactatcacggcgagctgccggaatgcccgacctgggatgccgaccgccagacgctctactggaccgatattttgcgccaggaaattcatcactatcagccgcacagcggcaagcacggcgtgatgcactttgccgaagaagtgggctgctttgccctgcgcaagcgcggcggtctgatcgtcgccatgcgttctgccatctggctgaccgatggcgaaggcaggctgacgcagaaagtgtgcgataacccgaataacccccagctggcgcgctttaatgatggcggcaccgacggccagggacgcttttatgccggaacctactgggggccgcgggattacaacggcgcgctgctgtgccgtgtagacgccgacctgaaaaccacggtgttacagtccgacattctgggcgcgaacgggctggcgttttccccggatggccggtggatgtacaccagcgacacgccgaatcatgtgatttatcgcacaccgctggatgcgcacggccagcccggtcagcggcagatctggaaaaccttcccgcgcggcaatggcagaccggacggcgcggccatcgacgctgaaggctgctactggagcgcgctgtttgacggctggcgtattgcgcgcttttcaccgcagggcgaggtgctggcggaaatccggctgccggtgcgctgcccgaccatggtctgcttcggcggcagtgacatgaaaaccttatttattaccaccacccgggaaaatatgtccgcagaagaaattaacgctcacccgctgtcaggtgcgatattttccctgcgcgttactgtccccggcattcagaaattaaaatttaacgagaactgaaaaaaatgaaaaccattggttttatcgggcttggcctgatgggcgaagccatgtccaaaaatattgtcaccaaatttaccggtacggttctggtcttcgatattaatcaggacgccattaaccggctggtattacagggcgcgcaggcggctatttccgtggcggatattgcgcagcgtgccgacgttattatcagcatggtgccccgctctgaacatgtgcgcgatatttatcagcaaatgctgccgtatttacatgacgggcaaatcaccattgatatgtcgactatcgatccctccgtgtcggtagccatttcccgccaggtgaatcataccggcgcaatcatgctcgacgcgccggtggtgaaatcggtgcctgccgcgcagaagggcgagctgggtatttatatcggcggtgataaagcagcatgggaaaaggtgtcgccgatcctcgcgatgatgggtaatcaccagatccatatgggcgggaatggccgcggcctggtgatgaaaatcgtgcataacctgctggtggcgggcattcagaacagcgtcaatgagatgctgaccgtggcggatcattacggcatcgataaagcggattttcataaagccatctcgtttggcggcgccaccaactggtatctcgacagcaaaattaacagcctgatcgccgaagatttccgcaccgccttctctctgcaaaatatggccaaagacgtcaacatcatgaaatcgctgctgacagaagccgggttatttctgccgggcgtgaatgtggtgaaaaacgtgtatgaccagggaatggaaaacggcctgggtggcgaagatttttctgccacctggaaagtcgttaagcacagcgccagaaaataattgaggaataagattatgcacagcgaaatcaacgtcatttataaaagtctgcacaataaagtcgtggccattaccggcggcgccagcggcattggcgaagaatatgtccgcgcctttgtgaatcagggcgcgcgggtggcctttctggattatgacgcccgggccggtgagaaactggctgcggaaatgggatgtctgtttttattttgcgacgtcacggatattaatcagcttaaagcctgttttacgcagattatcgaacagctgggcgatattgatattctgattaataacgcaggcagcgacgatcaccatactattgatgatctgacggaagactattttaataaccgtattaacgtcaatatgcgtcaccacctgttcgccattcaggcggttattcccggcatggcgcgcaaaggcagcggcagcattatcaatatgggctcgattaactggatgcgcgggcgtccgggacgggtgtgctattccctgtcgaaagcggcgattcacggctttacccgcacgctggcgcaggagctggggccgcgtgggatccgggtgaacagcctggtgccgggggcgatccgcactgccaaacaggacgcgatgtgggcgaaactcgatccggcggcggtaaatcagtttatcgaactccaggcgctgaaattccgtctcgacggcacgcactgcgcgcggctggcgctgtttctggcgtccgatgaatcctgcggctgcaccgggcaggactttatcgtcgatgcgggcttgtcgctgaattaaggagcggatatggacttctttagcttgttcacacctgatggcgtgatgctggaaaccggcgcggtgctgattgtggtggcggtgatgtttctttacaccttcgtcgggatttgcgcggggtttggcggcgggctgaccgccatgccgctgatcaccatggtgctgccgttaaaaatggcggcgccgatgtcggtgatggtcggcacggcgacggcgctgtacgccacctggctgtcgcgcaaggaaaccgactggaaatcggcgctggtgttgattgtgttctctctggcggggatcccggtggggctgtatgcgctgtcgtttctgcccgatcacattatgaagattggactcggcgcttttatcattctctattcgttctacagcctgtttattccgcgtctgccggtgtacgacaaacgctggattgccgcccctatgggcgccatcgccggagcgctgggggcggccttttccaccaacgggccgccggtagtgatgtacgggatgctgcgtaatctggcccccgccgcctttcgcggtacgctgaacgccttttttacggcgaacaatatcgcgattattggcgggctggccaccagcggtattctgaccatttccaccgtcaagctggtgattttctgtattccgaccatgatcctcggctcgctggtcggccagtacgttcacaagcggatttcggtgaaagtgtttcgcctgatggtgtttttgctgctgattgcctcaggggcgatgctgataaaaggggcaaccgggatctctgccgcaagcgccctgcttccggcgtttgggctgctggcggttctgcaactggcatttgggcggaaagtcgcggcgatacgcgcggcggaggaggcgcggtagtatttttgcgttatatgccgggtggcggcttcgccttacccggcctacaaaatcagtgataccgtaggcccggcaagcatgcgccgccgggcgatacgtggcggcttcgccttacccggccaacaaacctacgaatcggtgataccgtaggcccggcaagcgtgcgccgccgggcgatgcccgctcgttacatctcatcgtccggcgaggcgaggatcagctcgatttgcttgtttttcatcaggctgtgcagcgcctgcggcggggctttgtcggtaaagagtgccgtggcctgggtgacgttgccaatttccacggcggcggaggcggtgaatttggtgtgatccaccgccaccaggatttgccgggagtgggccatcatggtgcgggcgacgctggcttcattgacgtcaaactccagcagcgtgccgtcgttttcaatcgcgccgaggcttgtgatcaggtagtcggcgcgaaacccttccacaaaggataccgcgtgcggcccgataataccgctgttatgcggccgcagcgtgccgccgggcaccatcacttcaaagcgggtatttttgtagagaatatgcgccacccgcaggctgttggtgatgatgcgcaggtggttgtgattgagcagcgcccgcgcgatatgttccaccgtggtgccaatggtaatgaaaatggtcgacccgtcggggatatagtcggcaatggcttcggcgatggcttttttctcagcggtcagcgagatttcccgctcttcaaaggccgtgttaaccacgctcgacgcgcggcctgcgccgccgtgatgacgggtgatcagaccctgctcgctgagcttgcgaatatcgcgccgcaccgtctgcgtggagacatccagcagttgcgccagttcatcaatgttcatgtaaccgcgttcagcgatcaacgccagcagttgatcgtggcgcgggttgccggtcagctcggtggcactcatgcgtttccctcgtaacctcatcgttaatgggtcattttatacataaagtgacaaaaaagaccggacttgatcacaatcagggatgccgtcccgtccgccggggcgggtgcatttgagcgccgccacgccgctggcgaagcggacggcatcattgatgggctgctgttgcgccaggctgaacgccagcgcgccgtgaaagacatcgcccgcaccggtggtatccgccacatccacgcaaaaacccggttgatgatgatgttcagcgccggtcataaaatgacagccctgcgccccgctggtgacataaacctgcccgtcagtgacggtgcgggcgtactccagcccggccagcggatcatcaagaccggagaaccgccgcaggcccggcgcggaaaagacggcgtgatcgctgagcgccaccaggtcgtcaattttttgcggcgttacgtcgccatccagcagggttgttaccccggcctgttttgccagcgtgaaggcgcgtttcgccccgtcatgccagcgtacatccgccagcaccaggtcccattgtgaaaaatccagcgcatccagccagtcggcgtcaggcggcagatccgggccgggatagttaatgatgatccgctcgccctgcgcatccaccagcacggcagattgcgaggagctggcatttttgacgcgccgacaaaagcgggtgtttacccccagggactccagttccgcgagaagcttgtcgccagtatcgtcatcgccggtgcggccgataaagtccacctgcgcccccagttttgccgccgccactgccgccgtagccgccgggccgccgcccacttcccgatagtgatgcgccacatatttgcccccctccgtgggtaacgcttccacattgtagatccggtccatcacggttattccgacgcagacgatacgcaccatggtcattccttaaacgagtaacgatgccgtcattttaatttgccggattgttaaaaaagtgacggctgtcaattttttgaccataaattacaaatacgatcaaaaacagacacaaaagagcacgacgagagacataatctgacaaccagtaacgacgggagagtgaaatggccagcattgcgtttattggattagggcagatgggcgcgccgatggcgacgaacctgctgaagaaaggacatcacgtctgggcgtttgacgtgaacccggcgtcgatggagggcgtgatccgcgaaggcgcggtagggtgcagctctccggcccaggcggcggagtttgccgagttcgtcatcaccatgctgccaaacggcgatctggtacgtcaggtgctgttcggcgatggcggcgtctgcgaaaccctctccacgcgcgcgctggtgattgacatgtccaccattcacccgttgcagaccgatgccctgatccgcgagatgcaggcaaaaggatttcagatgatggatgcaccggtgggacgcacctccgatcacgcagtagccggtacgctgctgttacttgcaggcggcacggctgagcaggtggagcgcgccagcccggtgctgctggcgatgggcagtgagcttatcaacgcgggcggccccggcatgggcattcgcgtgaagcttatcaacaactacatgagcatcgcccttaacgccctctccgctgaagccgcggtgttgtgcgaggcgctgggcctgtcgtttgacgtggcgctgcaggtgatgagcggcaccccggcaggcaaagggcatttcaccacctcgtggccgaacaaggtgctgaaaggggatctttccccggcctttatgatcgacctcgcccataaggatctggggatcgccctggacgtggcgaatcaactgcatgtgccgatgccgctcggcgcggcgtcgcgggaagtttataacctggcgcgcgccgccggacgcgggcgtcaggactggacggccatcctggagcaggcccgcatcagcgccggcctcgcccctctcgtatcccagtaatgctgtaaaaggaccgatgtatgacgacttacacgcttaaagatattacccgcccttccggcggctttgcgatgctggcggttgaccagcgtgaagcgatgcgcctgatgttcgcggcagccggtgcgccacagccggtggctgaccatgtgctgacggattttaaagtcaacgccgcccgaaccctgtcccccttcgcctcggcgatcctcgtcgatcagcaattctgttaccgccaggtggtggagcagaaagcgatcgccccatcctgcgggatgatcgtcgccgccgatgcgtttattcccggcaacggtatcccggtggacagcgtgatcatcgataaagcggtcgatccgcaggcggtgaaacgcgacggcgcaaaagcgctgaaactgctggtgctgtggcgcagtgatgaggacgccgatcagcgtctggcgatggtgcgggaatttaatcagctgtgccatgcaaacggcctggtcagcattattgagccggtggttcgcccgccgcgccgtggcgataaattcgatcgcgagcaggcgattattgatgcggcgaaagagctgggcgacagcggcgccgatctctacaaggtggaaatgccgctgtgcggtaaaggcgatacgcagacgctgctcgccgcgtcccagcggctgaacgatcacatcgccatgccgtgggtgatcctctcctccggcgtcgatgaaaaactcttcccccgcgccgtgcgcgtggcgatgagcgcgggcgcgtccggttttctggcgggtcgcgcggtgtggtcgtcggtggtgggcctgccggacaccgaactgatgctgcgggatgtcgccgcgcctaagctgcaacgcttaggggacattgttgacgaaatgatggcgaagcgctgaggaggaacagatgaaatggtttaacacgctgagccacaaccgctggctggaacaggaaaccgaccgcattttcgacttcggtaaaaaggccgtggtgccgaccggtttcggctggctgggcaataccggtcaggtcaaaacggatgtgggcacccacctgtggatcaccgcccgcatgttgcatgtgtatgccgtggccgccggaatgggccgccccggtgcgtatgagctggtggatcacggtattaacgcgctgaacggcgcactgcgcgataagcagtacggtggctggtatgcctgcgtcaatgatgaaggggtgatcgatgcttccaagcagggttatcagcatttctttgtgctgctgggcgcggcgagcgcggtaaccaccgggcatcctggcgcgcgtccgttactggatgacgccattgcggtgatcgagcgttatttctggagcgaagcggagcaaatgtgccttgagtcatgggacgaggccttcagcaaaaccgaagattaccgcggcggcaacgccaatatgcacgcggtggaagcctttctgattgtttatgacgtcacccatgaccgcaaatggctcgaccgtgcgctgcgcatcgcctcagtgattattcatgatgtcgccagaaagagtgattaccgcgtcaacgagcatttcgacaaccagtggaacccgatccgcgattacaacaaagacaatcccgcccaccgtttccgcgcctacggcggcacgcccggccactggatcgaatggggccgtctgatgctgcatctgcgcgccgcgctggaagcccgctttgaaatgccgcccgagtggttactggaagacgcgaaaggcctgtttcacgccaccatccgcgacgcctgggcgcccgatggcgcggacggttttgtctattccgtcgactgggacggcacgccgattgtgcgcgagcgcgtgcgctggccgatcgtcgaagctatgggcaccgcttacgccctgtggagcgtcacgggcgacgcgcagtatgaagcctggtatcagaaatggtgggattactgcatgaaatatctcatcgactatgaaaacggctcgtggtggcaggagctggatacggataacaaagtcaccaccaaagtgtgggacggcaagcaggacatttatcacctgctgcattgtctggtgatcccccgcctgccgctggcgccgggtctgggccccgccgtcgccgccgggcttctggattgcaacgctaaataaacaataaaacttacagaggtcattatgcgtaccctacaccctgacttatccgctctggcgctgaccaccagcgctggcggctttaccttaacctaccagcagcgcctgatcctgcgtcatacgccggacgccgcctgtttatggacaggcgctggcacggcggatattgagatgttccgcggcaacttcagcattcaggatcggctgaatgaaaaaatcgccctgacggacgccaccgtacaggcccatgacgccggctggacggtgcgcttcggccgcggcgatgcggtgagcgcgacgctgaaaattggcgtcgatgacgcaggccgtctgctgctgacgctgcaaaacgatgacgcggcccataaccgtatctggctgcggctggcggccaatcctgaggatcatatttacggctgcggcgagcagttttcgtatttcgatctgcgcggcaaacccttcccgctatggaccagcgagcagggcgtgggccgcaataagcagacgctggtcacctggcaggcagactgcaaagagaatgcgggcggcgattattactggaccttctttccgcagccgacctttgtcagtacgcaaaagtattactgccacgtggacaacagctgctatatgaatttcgatttcagcgcgccggactatcacgaactggcgatctgggaaaatcaggccacgctgcgtttcgaatgcgcgcccacctacattcagctgctggaaaaactcaccgcgctgctgggccgtcagccggagttgccggactgggtgtatgacggcgtgacgctcggcattcagggcggcacagacgtgtgccagcaaaagctcgataccatgcgcaacggcggcgtgaaggtgaacggcatctgggcgcaggactggtccggcatccgcatgacctcctttggcaagcgcgtgatgtggaactggaaatgggacagcaataactatccgcagctggattcccgcctcgcgcagtggaaggaagaaggcgtgcagttcctctcctatatcaatccctatgttgccagcgaccgcgagctgtgcgcagaggcggcgcgcctcggctatctggcgaaagataaagacggcaatgattatctggtggagttcggtgagttttacggcggcgtggtggatctgacgaatccggccgcgtacgactggttcaaaaatatcatcaaacagaacatgatcgcgctgggctgcggcggctggatggccgacttcggcgaatacctgcccaccgacaccgtgctgcataacggcgtcagcgcagagatcatgcataacgcctggcctgcgctgtgggcgaagtgcaactacgaggcgttgcaggagaccggcaagctcggcgagatcctgttctttatgcgcgcgggcggcaccggcagccagaaatattccgtgatgatgtgggccggagatcagaacgtcgactggagtctggacgacgggctggcgtcggtagtgcctgcggcgctgtcgctggcgatgaccggccacgggctgcatcacagcgatatcggcggttacaccaccctgttcgacatgaaacgcactaaagagctgctgctgcgctggtgcgatttcagcgccttcacgccgatgatgcgcacccacgagggcaatcgtcccggcgataactggcagtttgacggcgacgcggaaaccatcgcccacttcgcccgcatgaccaccgtcttcaccaccctgaagccttacatcaaagccgccgtggcgcagaacgcgaaaagcggcctgccggtgatgcgtccgttgttcctgcactacgaagacgacgcccgttgctatgagctgaagtatcagtatctgttcggccgcgatctgctggtcgcgccggtacatgaacaggggcgcgaggactggacgctgtatctgccgccggatgcgtggatcaacctgtggaccggggaaagctgtgccgggggcgatattaccgtggacgcgccattgggcaagccgccggtattttatcgcgccgacagtgagtgggcggcgctgttcagctccttacgcacaatctgaatggcatccagcgaggaacgatcatgagtcagtccagcgatccggcaaccctgaagttgccgttcaaagagaagctcgcctatggcatgggcgatctcggctccaatatcctgctggatattggcacgctctatttactgaagttctatacggatgtgctcggtctgccggggacttacggcggcattatctttttgatcgccaagttctttaccgccttcaccgatatgggcaccggcatcatgctggattcacggcgtaacatcgggccgaagggcaagttccgcccgttcgtactctatgccgcgtttccggtgacgctgctggcgatcgccaactttgtcggcacgccttttgagatcaccggcaagacggtgatggcgacggtgctgtttatgctgtacggcctgttcttcagcatgatgaactgctcctacggcgcgatggtaccggcgatcaccaaaaacccggatgagcgcgcgtcgctggcggcctggcgtcagggtggcgcgacgctcggcctgctgctctgtaccgtaggctttgtgccggtaatgaacctggtggaggataatcagcagctggggtatatcttcgcggcaacgctgttttcggtgttcggcctgctgtttatgtggctgtgctatcgcggcgtgaccgagcgttatgtggacgcgcaaccggcgaacgccgcgcaaaaaccggggctgttgcagtcgttccgcgccatcgccggtaaccgtccgctgtttattttgtgtatcgccaacctgtgcaccctcggcgcctttaacgtcaaactcgccattcaggtctattacacccagtacgtgttaaacgatccgattttgctgtcgtatatgggctttttcagcatgggctgcatcttcttcggcgtgtttttgatgcccggcgcggtcaggcgtttcggcaagaaaaaggtctatatcggcgggctgctgatttgggtggcgggcgatgtgctgaactacttcttcggcggcggttcggtgagctttgtggcgttttcctgcctggcgtttttcggctcggcctttgtgaacagcctgaactgggcgctggtgtccgacaccgtggaatacggcgaatggcgcaccggcgtgcgatcggaagggacggtgtacaccggttttaccttcttccgcaaagtgtcccaggcgctggcgggctttttccccggcctgatgctgacgcaaatcggctatatccctaacgtcgtgcagtcggcagagacgcaggaaggcctgcgccagctgatctttatctggccctgcgcgctggcggtggtgacgattatcgccatgggtctgttctataacctcaacgagaaaatgtatgtgcgtatcgttgccgaaatagaaacccgtaagcggatggcgtaatgcaacagacaatgacgccctgcggggcgtcatgaggaacgattatgacaacccatgatccgttaaccctgaaactgagtctgcgtgaaaaagtcgcctacggaatgggcgacttcggctcaaatttgatgttgtgtatcggcaccctctatttactcaagttttataccgatgagttagggatgccagcgttttacggcgggatcatcttcctggtggcgaagttctttaccgccttcaccgatatgctgaccggcgtactgctggatcagcggcgcaacatcggcgaaaaagggaagttcagaccctttattctgtatgcctctttcccggtggcgctggtcgccagcgcgcagtttatggcgaacgactttaccctgacggtaaaaaccgccattgctaccgggctgtttatgctgttcgggctgtgctacagcctgatgaactgttcatacggcgcgatggtaccggcgatcaccaaaaatccgcaggagcgcgcgcatctggcggcgtggcgtcagggcggcgcgacggtcgggctattgctgtgtaccgtaggctttatgccgatccaggcgctgtttaccggcaggccggcgcttggctatcaggtggcggcgttggtgtttgtcaccggcggtctgttctgtatgtggtggtgctacagcggcgtgaaagagcgctatgtggaggtcacgcccgatcaccataaaccgggcattcttaattcattctgcgcgattttccgtaatccgccgctgctggtgctgtgcatcgccaacctgtgcacgctggcggccttcaatatcaaactcgccattcaggtgtattacacccagtacgtgctgaacgatattcatctgctgtcatggatgggatttttcagtatgggctgcattctggtcggcgtgtttctggtgcccggcgcggttaagcgcttcggcaaaaagcaggtctatcttggcggcctgatgctgtgggcggtgggcgatgtgctgaatttcgtctggggcagcagctcgttgctgtttgtgctcttctcctgcatggcctttttcggcacggcctttgtcaacagcctgaactgggcgctggtgccggatacggtggattacggcgagtggaaaaccggcatccgcgccgaaggatcggtttacaccggttataccttttcgcgcaaaatctccgccgcgctggcaggtttcctgccgggcatcatgctgacgcagatcggttatattcccaatgccatacagagcgccggtacgctgctcggcctgcgacagctgatcttcctctggccctgcgcgctggcgatcgtcgcggcactgacgatgggattgttttataagcttaatgagcaacgcttcgcgatgattattgcggagatcggggcgcgaaaaaagcagggtacgcacgctgtacccttcgcaaaaggggaaactccagcgataaaggtatagaaaggaaataaaaaagccccgtcttcgcaggcggggcttcgttttcagtacgaaatcggcttacgcgtctttcggaccacgcatcgcgcgtttacggtcgttctcggtcaggtgacgtttacggatacggatagaggttggggtaacttctaccagttcgtcgtcatcgatgaactccagcgcctgctccagcgacattttgatcggcggaaccagaaccgtggcttcatcagtaccggaagcacgcatgttggtcagcttcttaccggtcagacagtttactgtcagatcgttagaacggctgtggataccgatgatctggccttcgtacacttctgcaccgtgacccaggaacagcttaccgcgatcctgcaagctgaacagcgcaaacgcgactgctttaccctggccgttggagatcagcacgccgttgttacgctggccgatttcgcccggcttaacatcgtcgtagtggctgaaggtggagtacagcagaccggtaccggaggtcatggtcatgaactcggtacggaagccgatcaggccacgtgccgggatcaggtaatccagacgaatacggcctttgccgtcagggatcatgtctttgacatcgcccttacgctcgcccattgcctgcattaccgcgccctggtgctgttcttcgatgtccagcgtcacgttttcgaacggctcctgcatacggccatcgatcatacggttgataactttcggacgggaaaccgccagctcaaagccttcacgacgcatgttttcgataagtacggacaggtgcagttcaccacgaccggatacacggaacgcgtccgcatcttcggtttcttcaacgcgcagcgccacgttgtgcacaagctctttgttcaggcggtcaaggatctgacgggaggtaacgaatttaccttctttgccacagaacggagaggtgttgacgttaaagaacatggtaacggtcggttcatcaacagacagagccggcagcgcttcgacattctgcggatcgcagatggtgtcggagatgttcagttcgcccagaccagtgatcgcgatgatgtcgcccgcttcagcttcagtggattcgatacgttccagaccgaggtggcccagcactttacccactttaccgttacgcgttttaccttcgctgtcgatgatggtcacttgctggttcggtttcaccttgccgcgtttgatgcggccgatgccgataacaccaacatagttgttgtaatccagctgggagatctgcatctgcagcggaccatcaaggtcaacgttcggcgcaggtacatggtcaacaatcgcctggtacagcggggtcatgtcttccgccatatcagtgtgatcgttaccggcgatgcccatcagtgcagatgcatagatgatagggaaatcgagctgctcgtcagtcgcgtcgaggttaacgaacaggtcgaatacctgatcgacaacccagtccggacgcgcgccaggacggtcaactttattaataacaacaatcggcttcaggccgtgtgcaaacgcttttttggtaacaaagcgagtctgcggcattgggccatccattgcgtcaaccaccagcagcacggagtctaccatggacataacacgttcaacttcaccaccgaagtcggcgtgacccggggtatcaacgatgttgatacggtagtcattccatttaatagcggtgtttttagcgaggatggtaatcccacgctctttctccaaatcgttggagtccatcacgcgttcggtcgtttcagcacgctcgctgaaagtaccggattgctgcaggagcttgtcaaccagggtagttttaccgtggtcaacgtgagcaatgatggcgatgttacgcaaattttcgatcacaactttgcctcaggcattagaaatagcgcgttattgtacacgtattaatcgcagtacagaacaggatcacaaagaacctttacaaacaatacggaaagtaaggctttgtgatcgctttcacggcgcagtaaaggggtgccttaacgaaaattgcaccaatatagtgcttgtggttcacaatcaagcactatactggtgcaatgtttccattctggtgcagcccttttgcactatgacgtgcatgataacgccttttgggggtgtttttaaagttggcacagatttcgctttatatcctgcagagcaacaatgccgtttatgagcagtgttttctgacctcgttaccacgacgacaatgacaaaatccgggagagttaagtatgtccgctgaacacgttttgacgatgctgaatgaacatgaagtgaagtttgtcgatttgcgcttcaccgataccaaaggtaaagaacagcacgtcactatcccgtcccatcaggttaatgccgaattcttcgaagaaggcaaaatgtttgatggctcctcgattggtggctggaaaggtatcaacgaatccgacatggtgttgatgcctgacgcgactaccgctgtcattgacccgttctacgaagaaactacgctgatcatccgctgcgacatcctggaacccggcaccctgcagggctatgaccgtgacccgcgttctatcgcgaaacgcgctgaagagtacctgcgttctactggcatcgccgacaccgtactgttcgggccagaaccagaattcttcctgttcgacgatatccgtttcggcagctccatctccggttctcacgttgctatcgatgatatcgaaggcgcatggaacaccggcaccaaatacgaaggcggtaacaaaggtcaccgtccggcagtaaaaggcggttacttcccggttccaccggtcgattcttcacaggatctgcgttccaccatgtgtctggtgatggaagagatgggtctggttgttgaagctcatcaccacgaagtggcaactgcgggtcagaacgaagtggcaacccgcttcaacaccatgaccaaaaaagccgacgaaattcagatctacaaatatgttgtgcacaacgtggcgcaccgcttcggtaaaaccgcgacctttatgccgaaaccgatgttcggtgataacggttccggtatgcactgccatatgtccctgtccaagaacggcaccaacctgttctctggcgacaaatatgccggtctgtctgagcaggcgctgttctacatcggcggcgtaatcaaacacgctaaagcgatcaacgccctggcgaacccgaccaccaactcttacaagcgtctggtcccgggttacgaagcgccggttatgctggcttactctgcccgtaaccgttctgcctctatccgtattccggtggttgcttctccgaaagcgcgtcgtatcgaagtacgcttcccggatccggcggctaacccgtacctgtgcttcgctgcactgctgatggctggccttgacggtatcaagaacaagatccacccgggcgaagcgatggacaaaaacctgtatgacctgccgccggaagaagccgcagagatcccacaggttgcaggctctctggaagaagcactgaatgcgctggacgcagaccgtgagttcctgacagctggcggcgtattcactgacgacgcgatcgatgcttacatcgctctgcgtaccgaagaaaacgaccgtgtgcgcatgacgccgcacccggttgagtttgaactgtattacagcgtttaattattaagactcggtgaatttcttgtcgcagctgtgttggctgcgacaagacagacgcctgaggttttttgttgccgtggaactttagcccatctcaggatgggcttttttctccacgcccggcatatatttgcgaacaattcaccgacttacacttataatgcactgtattggtgcacactaaggagactgctgaatggcaacaggcgtggtgcccgatgctgggcagatcctcaattctctgatcaacagtattttgctggttgatgatgacctggcaattcactatgcgaacccggcggcgcaacagttgctggcccaaagttcacgcaagctgtttggcacaccgttacccgaactactgagttatttttcgctgaatattggcctgatgcaggaaagtttgcaggccggacaaggctttaccgataacgaagtgacgctggtgatcgatggccgctcacatattctttccctgaccgcgcaacgtctgccggagggcctgatcctgctggagatggcgcccatggataatcagcgtcgcctgagtcaggagcagttacagcacgctcagcagatcgccgcccgcgacctggtgcgtggcctggcccatgaaattaaaaatccgctcggcggtttgcgcggcgcggcgcagttgctcagcaaagcgctgcccgacccggcgctgatggaatacaccaaagtcattattgaacaggctgaccggctgcgaaatctggtggaccgtctgttaggcccgcagcagccgggaatgcacgtcacggaaagtattcataaggtggcggagcgcgtggtgaagctggtatcgatggagctgccggaaaacgtcaccctggtgcgcgattacgatcccagcctgcccgaattaccgcacgatcccgaccagatcgaacaggttttactgaatattgtgcgcaatgctctgcaggcgcttggcccggagggcggcgagattgtgctgcgtacccgcacggccttccagctgacgctgcacggcgtgcgctatcgcctggccgcacgcattgatattgaagataacgggccgggtatcccgtcgcatttgcaggacacgctgttttatccgatggtcagtggtcgcgaaggcggtaccgggcttgggctgtccattgcccgcaatttaatcgatcagcactccggcaaaattgaattcaccagttggccaggacataccgaattctcggtgttcctgcctattcggaagtagaggtatttatgcagcgagggatagtctggatcgttgatgacgatagctccatccgctgggtgctggaacgcgcgctcaccggggctggcttgagttgtacgacctttgaaagtggcaacgaggtgcttgacgcgctgaccaccaaaaccccggatgttctgttgtcggatattcgtatgccagggatggatggcctcgccctgcttaaacagatcaaacaacgacatccaatgcttccggtcatcataatgacggcacactccgatctggatgcggcggtcagcgcctatcagcaaggggcctttgattatctgccgaaaccctttgatattgatgaggccgttgcgctggttgaacgtgcgatcagccattatcaggagcagcagcagccgcgtaacgtgcaggtatttggcccgacgacggatattattggcgaagccccggcgatgcaggatgtgttccgcattattggccgtctgtcgcgctcatccatcagcgtgctgattaacggcgagtccggaaccggtaaagagctggtggcgcatgccctgcatcgccacagcccgcgcgtgaaagcgccgtttatcgcgcttaatatggcggccatccccaaggatttgattgaatctgaactctttggtcatgaaaaaggggcctttaccggggcgaatacgatccgtcaggggcgctttgaacaggccgatggcggcacgttatttctggatgagatcggcgatatgccgctggatgtgcagacccgcttactgcgcgtgctggcggacggacagttttaccgcgtcggcggctttgcgccggtaaaagtggacgtgcgtattattgccgccacgcaccagaatctggagctgcgcgtgcaggagggaaaattccgtgaggatttattccatcgcctgaacgtgatccgcgtgcatctgccgccgctgcgcgaacgccgggaagatattccgcgtctggcgcgccacttcttacaggtcgccgctcgcgaactgggcgtggaagccaagcaactgcacccggaaacggaagcggcgctgacacgtgtggcctggccgggtaacgtgcgccagttagaaaacacctgccgctggctgacggtaatggcggccggtcaggaagtgctgattcaggatctgccgggggagctgttcgaaaccactattccggacagcccgtcgcaaacgctgcccgataactgggcgacgctgctggcgcaatgggccgatcgcgcgctgcgttccggtcatcaaaacctgctttcggaagcgcagccggagatggagcgtacgctgcttaccacggcgttacgccatacgcaggggcataaacaggaagccgcccgcctgctcggctggggccgtaataccctgacgcgcaagctgaaagagctgggaatggaatgattttcgggatgaatgtaaagatggattcatagccgcaaattgctgctattttgagctttactgttccgatgagttgagtatgatcaggcgcgttcacgcgggagagagatcatgctggagtcattaattcattttgtatcgagcggcgcagacgtcgccactgcagccagccagacgccccatacggcaatcgcggctgtcctgtgcgcggcgctggtcgggctgttcagttaaatcgtatcccctcctggcgaggggatacgcttatatgacgcgcgagaactgctgcatccgcgctttctggcgcagataagcatcgaagcacatgcagatgttgcggatcaacagacggccttttggcgtcacctgaatacccttctcatccacctccaccagcccgtctttcgccagcggcgcaagcagttttaaatcctcagcaaaatagtcctggaaatccacattccatgcgcgttcgaccgcggcgtattccaggcggaaattgcagatcagcgctttgatgacatcgcggcggatacagtcgtcgcgggtgagcgcgatgccgcgccacagggcgttgccggtctcatccacctgttgataatagcgtttcagctctttctggttctgcgcgtagctgtcgccaatcatgctgatggccgagacgccaaagccaagcagatcggtatcgccctgggtggtgtaaccctggaagttgcggtgcagcacgccttcacgctgggccacggccagctcgtcatccgggcgggcaaagtgatccataccaataaattgatagcctgaatccatcagcgaggaaatcgtctcctgcagaatatccagtttctgctgcgcggtcggcagatcggcatctttgattttgcgctgggcggcaaagagagacggtagatgcgcgtagttgaacacgctcaggcgatccgggctgagctccgccacgcgtttgagcgtgaaggcaaagctttccggcgtctgcttcggcaggccataaatcagatcgatattggtcgaggtaaagccgatgtcacgcgcgcgtttgatcagcgcaaagataaattcttcatcctgctcacggttcaccaggcgctgaacttctttgttgaagtcctgcacgcccatgctcaggcggttaaagccttcgtggcgcaggtggtcgagcacatcaagttcgatttcccgcggatcaacttcaatcgagatttccgcatccgcattaaaactgaactgcgaacgcaaaatttgcatcaggcggctgatctgggctttattaagataggttggcgtcccgccgccccagtgcagctggctgacctgacggccggcgaacagcggcgcgcggtgcaggatctcctgctccagcgcatcaagatattgatcggctttatgctgctggcgggtgacgattttattgcagccacagaagtagcagagcttgtggcagaacggaatatgcacatacagcgacagcgggcgctccgggtaacgggcaacagcctccagaaactgcggttcgccgtaagattcggcaaactccagcgcggtcgggtatgacgtataacgcggcccggaatagttatatttctggatcagggccagatcccagtcgattaactgcgaagacatgcttactccttccggtaatgccgtcggcgagtccggcggcctggactgatcccctggcgggtcatcagccggttgcgcagccttttttgctgctgcgacaaccgtcgtagtttaacgaataaccacgccagataacatataaccggaagggttattagcaggacgggtaagcccatgcagtaaccgttagttgccacccttaagcaggcgcatcatatcttcttttttgtcttcctcttcttcgtcgtcttcatcgtcgtaagaaagacccagctgctgcatcagctcatcaattctgtccagcttagcatccacccatgcctgatcttcactgctcagggtttcgccatcttcaagacgttccagcagcgcatccaggcgctcatccgtttccagcatatccagttcagcctgcggtgaaagcataggtttctcgctcttaggtttttgctgacgcgctaccggggcggcggttttgctgacgcctaacggtaccggggttttactgccaatacggggatctttctgcttgttctgaccgcgggagccggaggcgctgtcgccgcctgacgcacggctgcccgccgcattgccgctgtgtttcttctggcgcttgcgatcgcgagattcctggttgatttcatcgcgggttttacgacgcgtttttgcggggccattgccacgcggagccgacgaaggtttattcataatgtttggtcttgagccgtttttattcagtatagaattgcggcggaatctagcagaaagcaagcaaagaaaaaaggcgacagagtaaactgtcgccttttttcttgtcccaccacccgaaacgggctgaaccatccgtgtttgcttgcaacctgccctgtctgtcctttagcggtaaaccgtccctgattaaatccctgtccctgtaaaaacgtctccagacgtttatcatcccttaaaatcccggtcttcgcctcctggcgctccagaccccttatccttaagtctgcatcctgtggcgtcctcgcctttgcacactactttacctttttgacgaaaactcacaagtatgtaacacgcgttacgccatgctttaggaaaattccatactggcaggtctttaattaacaataggttagacaaaggtcaccctgcaactattcttaaatgtcccataaaagccgtggctaatgtcttacaaaacgaatggctattttgagccgatggcgagaaaaccagccttttcccggcgttcaggtataatcccccaaagctttatttatggagacgaccgctttgactaaattgaattatcatcagacgcattttgtgatcagtgcgcctgatattcgccacttgcctgccgataccggaattgaagtggcctttgcgggccgttccaacgcaggcaaatcaagcgcgctgaataccctgactaaccagaagagcctggcgcgtacgtccaaaaccccgggacgcacccagcttatcaacctctttgaagttgccgatggcaagcgcctggtcgacttaccgggttatggctacgccgaagtgccggaagagatgaaaatcaaatggcagcgcgcgctgggcgaatacctggaaaaacgccagtgtttgcagggcgtggtcatcctgatggatattcgccatccgttgaaggatcttgatcagcaaatgatcctgtgggccgtggaaagtgatattcaggtgctggtattgctgaccaaagccgacaaactggcgagcggcgcgcgtaaagcgcaggtgaagatggtgcgtgacgcggtactggcctttaacggcgatgtgcaggtagaagccttctcttccctgaaaaagattggcgttgataagctgagtgaaaagctggatacctggtttaacggcgtaccgacggcagaagaaaacgcagaataagaacgggcgcggcaggctgctgcgctgtgttttttaccgctttgcacaataaaaaacgccccagtcattactgactggggcggctaaaatattcagccaaatccgattacgtgaagtaaaaggtctgaaagatagaacatcttacctctgtaccctacgtctttaactctactcttttttcagacggacacaaagtgctttttgtaattttttttcattctttacatagcgaattctaatgattgtcacaaaacgtgcggcgttatgttgcttacttacataaacaccgcgttattcattgaacccttagtgcgcctgatcccagttttcaccgctcccgacttccaccagcaacggcacgtccagcctggtgctgttttccatcagttcatggatctttttagataccgcttcgacgtcatctttatgcacttcgaacaccagttcatcgtgaacctgcataatcatccgcacacgcggtttttccgtttctaaccactggtcaacggcaatcatcgcgcgcttgatgatgtcagctgcggtgccctgcataggggcgttgatcgctgcgcgttccgccccggcacgacgtgcgccgttgctggatttgatgtccggcaaatagaggcgacggccgtcaagcgtttccacgtagccctgctctttagcctgcgcgcgggtacgttccatatattcctgcacgcccgggtagcgctcaaaatagaggtccatatacttttgcgactcgcggcgcgggatattgagctggcgcgacaagccaaaggcgctcatcccgtagatcaacccgaagttaatggctttggcgctgcggcgctgttcattggatacgctttccagcggcatgccgaacacttctgccgccgtggcgcggtgaatatcttttccttccgcaaaggcggacagcaggcctttatcgcgcgacagatgcgccatgatgcgcagttcgatttgcgagtagtccgcagagacaatcacgtaatcttccggcgcgataaacgcctgacggatacgtcgcccttcctcattgcgcaccgggatgttttgcaggttgggatcggtggatgacagtctgcctgtcgcggtcaccgcctgatgataagaggtatgcacgcggccagttttgggattgatcatcagcggcagcttgtcggtgtaggtcgatttcagcttcgacaacccgcgatgctcaagaatgattttcggcagtggataatccagcgccagctcttccagcacctcttcggaggtggacggcgcgccgcccggcgttttcttcagcggtttaatgccctgtttttcgaacaggatggtctgcaactgcttggttgatgccaggttaaacggctcgcctgcgatgtcgtgggcgattttttccagttctgccaggcgcagcgtgatttcgccggagtgcttgtgcagcacggccggatcgattttaacgccgttgcgctcaatgcgtgacagcaccggcaccagcggcatctcgatattgttgaaaatattcagcgggccggcgtgctgttgcagctttggccacattttcagatgcagttgcagtgtgacgtcggcgtcttctgccgcgtaacgacccgcctgctccagatcgatctgattgaaggtcagctggtttttacctttaccggcaatctgctcaaaggtgatggtggtatgtttgagccagcgatcggcaagggtgtccatatcgtgtcgcccgaccacgctgtccagaatgtatgactccagcatggtgtcaaacgcgatgccgcgcagctcaataccgtaattttgcaggatgccgcggtcgaacttcaggttttgcccgaccttcagcactttttcatcttccagcagcggcgtaagcaattccagcgctcgttcacgggaaatctgttcaggcgcatccagatagtcatgggcaacgggaatatagatcgcaacgccaggctccaccgcaaaagagaggcccaccagattggcgctgacgttatccaggctgtcggtttcggtatcaaaagccagcaccggggctttttgcaggcgcgggatccaggtctttaatgtctcttcgtccagaatggtcaggtaattatcagaggagagcacggtcgcgggctcgtcatcttcctccacgacaattgtggcttcaaagggacgggccgcagatttagcggctttcgtctgcaaccatttaccggcttcaagatcgaccgtccagcgtttgaattcatacttccggaacatctccatcagctcgtcaacggccggtgcctttacctcaagcttgtcgcaggtcagctccagctcaacatccgttttgatggtggccagctgataagagaggtaggccacttctttgttttgttccagcttcgccgccatggttttcgccccacggaacgacagaccggcaattttttccggctcggcatagagcgcatccagcccacccagcccctgtagcagcgcctgcgcggttttctcgcccacgccgggtacgcctgggatgttatccgaggaatcgcccatcagggcgaggaagtcgataataagttccggcggtacgccgtatttactgatcacctcttccggaccgagaatggtgttcgacatggtgttgatcagggtgatgcctggcgtgaccagctgcgccatatctttgtcaccggtactgatcagcaccgggcggcccattttttcggcttcacgcgccagggtgccgatcacgtcatcggcttcaacgccagacaccgccattaacggcaggcccatggcttttaccatcgcatgcagcggttcgatttgcgcgcgcagatcgtccggcatcggcggtcggtgagatttgtagtgttcaaataactcgtcgcggaaggtcttgcctttggcatcaaacaccacagcagcatgcgtcggctggtactgaaggatcaggcttctgagcatattcagcacaccgtacatcgcaccggtaggttcaccggcgctgttggtcagcggcgggaacgcatggtaagcgcgataaaggtaagacgagccgtcaacaaggataagtgggttttctgggatctgaaccatgatgtccgtgcctgtttattaaattatggttaaaggatgccacagaccggcgcaaacttcagtttttcgccgaatttgcagtaaaagatttctcgatctccgggatcgctcgcatcttcattctgtggataactttgtgagttatttcgatagcactggataattgtgctttactgacgatcgggattttaaaaatatcctttacattcagataaataaaagcattagaatgatcgttattgcggatcgatgacaatttactccatgtggatataagcgtttggtctgaatgcgcgatcggtaagcaggcgttgaaataggatggggtggacgtgaagcgcagggccagcaggaaaagcacaacgccgatcgatgaccggcgttgtagaaacttatttcagcgaaacgaggtgcttaacggtatcagcatattgctggacaaaaacgtccatattgctggtatccataccctgcgggttaagctgatatttgccgttaacaaacatggccggtacgccctgcagttgcagatcggctgcggctttctcctgctgtgcaaccagcgatttcacgacgaagctgtttaacgccgcatcgtaatcttcacccttaacgccggcatcgacaaacactttacgaatgtcagcaacgttctgcaccgtctgggttttctgtaccgcttcgaacataggggccgtgatcttatcttccacgcccagcgccatcgccactgcccatgcttgtgtcaaatccttgcccagcgggccgaggaattccacatggtatttggtcattttggtgccttccggcagcgttttcttcaccgcgtcagagatgtgccagacgcgttcaaaatcgtagcagtgcgggcagtagaatgagaaaaactcaagaacctgaggttctccggctacaggtttatcaagcgtgatgtactgtttgccgtcggtgaactgcgcagcggaagcgctgaatgccagaatcatacctgccagcgccagccaaatcttcttcatgttaatgctctcctggatgtttgacgttaatacataggtgttaattgcaaaggcggctcgcgaagaaccttaacctgctcaatgaaagtcagggtttgctgatgccagtaatcttccccggtcagccacggaaagtttctgggaaacgccggatcgccccagcgtctgataagccacgccaggtaatagacctgccgcatggcgcgtaacggttcgatgagagccagttcgtccgtattaaactcactgaactcctcataggcttcaatgatcatttccagctgcatgcgctgctcggctttatcgccgttaagcagcatccagagatcctgaatggccgggccgttgcgcgcatcatctaaatcgacaaacagcgggccgtcccgccacaggatattgcctgcgtgacaatcgccatgcagacgcagccgggtaaagcggttataccattgccctgtgacttcgttgatcagagtgtcagtggcgcgcagaaaagcatctttaagcccggacgggatcagcgcggcgttttcaaaaacggcgcggggctcaagcaggtattcattaacgccgatgtcaggacggaaggcgaaacaggttttgcgcccggtctggtgcagacgccccagatagcggccaacccactccatttgatcaaggctgtcggattcaaactgacggccaccgagactgggaaaaacggcgtagtaaaaaccctgatgggtgagcagcgtctgcccgttaaacgaaaggggggcggcgacaggaacctcatcgctcaacaactcttctgcaaactgatgctcttcgcggatctgatccgctgaccagcgttgcggacgataaaatttgaccacatagcggcgacggtcttcatcctggaactgatagacacggttttcataactgttaagcggggtgagaccagaatcaacccggatcccctgcgcaaacagcgcatccatgatggtatccgggtgtagcgtctggaaagtaaaagcgttgtcggtcatcccaagttccggaaattactgcgaatgactcagaatatcattttgtggccatttcggtggcgccgcttacaagcttttactctttaattacgccacgggcgcgcagcagggcggttttaaaatcctcttcgtagtctttctgaatacccgggatcgccgcatctttcgcggagtcacgcattttcaggtgatagatcagaatatcatcagaaaggtctgccagttcgccttcataacctgactcctgcgccagtttctgcaaaaattgcatcaggttaagttccggctctttttgccaggcaggctggaggagttcgatgacttcgttcaggcgtttacatttcatgctcagtgctccttattttgatagagacacgttagcagggtcaaacccacaataaaagaggcgatattagtgtatcagtctggagccatcaccggcgttgtgctggctggcggtaaagccacgcgcatgggtggaaaagataaaggcttactggagcttaacggtcagccattatggcggcacgtcgctgaaaagctggctgcgcaggtggacgcggtggttatcagcgccaacagaaatctggccgtatatcaggcgagcggctatccggttattcaggactctctggccggttttcccggcccgctggcgggcatgctggcggttatgcagcaggtgaacagcgagtggttcctgttttgcccgtgtgatacgcctgcaattcccgtggatctggcggcgcggctgcgggccggtcttaatggcgcgcctgccgcgtgggtgtccgatggcgagcgcgatcatccggctattactttgatgcaccgtcagcttgcacctttcctgacagaatatctggcatccggcgaacgtcgcgttatggtggctttgcgccaggcaggaggaaaggcggtggattgcagcgacattaaatccgcttttattaacgttaatacgccagaggatctggctggcagacaggagcatcaatgatacctttgctggcgattgccgcctggagcggtacgggtaaaacaacgctgcttaaggcgctgatccctgaactctgtgccagagggatacgcccggggatcatcaagcatacgcatcataatatggatgtcgataaacccggtaaggacagctatgaattgcgaaaggcgggcgcagcgcaaacgctggtcgccagccagcaacgctgggcgctgatgactgaaacgccggaggagcctgcgctggatctggcgtatcttgccagccgtatggacagcagtaagcttgatattattctggtggaaggttttaagcatgaaccaacggcaaagattgtgctttttcgcagcgctgccggtcatgatgtgagtgaactggtactggatgaacacacgatagccgttgccagcgatattgccttaaaggtgaacgtgccgacgctggatctgaatgatgttaacgcaatagcagattttataatgcgctggatgaagagctgagaaagttctttttttcattttcagcgcgcaacgcaaaaaggccatccgtgaggatggcctttcgcttgtttgatgcctggcagttccctactctcgcatggggagaccccacactaccatcggcgctacggcgtttcacttctgagttcggcatggggtcaggtgggaccgccgcgctagtgccgccaggcaaat

SEQ ID NO: 6 - DNA, 120030 bp, Enterobacter sp SA187
gcggtcccacctgaccccatgccgaactcagaagtgaaacgccgtagcgccgatggtagtgtggggtctccccatgcgagagtagggaactgccaggcatcaaattaagcagtaaaccggggtgacaaccggtggttgtaaagaaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaaattatcctttgcttcggcaaaggattttttttgtctgcaatttatcccatctttgattttttccctgctgacgataaaaacatggcgtccctgcgcatgttttcttactccagtacgttgattttaagcagatccttgatatgactctgcttatcgctgttctgtaaccagatggcatacagcggtcgtgaaagcgtcagactatcagtgacggtatgcagatccgccttgttatttgcccacgacaccggcagccaggtgtatccctcaagcgcggccagttgctgacgggcgatctcagcggagctggtcgttaacagcggaatatcatcgctgttaataagccctgcctcatgctgctgaaaatcaggcccccattccaggcgcagataattcaggctggatttcgtcttacctgccgctgcacagtagagcgcaagcgtgaagtgccccagcaactgactgctgaattcatccatcttgggcgcttctgtggtgatgagcagatccagttgtctttcgtgtaactgtttcaccagcgactgccgttgcgcgatccgcgcttcaaactgcaaattcttctgtgactgatacaggcggcttaaccagccgttgagcatacactcccataacgacgcactggcgccgatggacagctcattgtgacgtgaggtatgcgctacctccttgcgtgccgcctgccacgtactcattaacgtttctgcataaggcaacagcttttccccggctggcgtcagccgtatgttgttgcgatgacgggtgaaaagattcacaccgagctggttctctaactgacggatccgaaaactgaccgccgattgcgtcaagtacagcgcttccgcagcgcgaccaaagtgtcgagtcctgctgacttccaggaaagtttttaacaattccgtatccacagctttctccacaaatttatttgtcgttatgatttaaatgttttgttttacactctgtcaagcgtaactaatactccgcgccataaatagctcggccaaagaattaggagcgtgcaggatggcggaaagctttacgacgacgaatcgttttttcgacaataaatactatccacgtgggttctcgcgtcatggtgacttcaccatcaaagaagcccagttgctggagcgccacggatacgccttcaatgaactggatctcggcaagcgtgagcctgcaactgaagaagaagttcagtttgttgccgtatgccgcggtcagcgcgagccggtaacggaagcagaacgtgtctggagtaaatacatgacacgtattaagcgtcctaagcgtttccatacgctctccggcggtaaaccgcaggttgaaggcacagaagactacactgagtctgaagattaaagaaaaggggcgtaaagccccttttttatttctatcgctaacccagcatcttttgtaaatggataagtaaccggtcaatggcgcgatagcttagcgcttcctgtaaatgccgccgctgaatacttttctgctcctcaagatccgcgagcgtacgcgctacctttaacaggcgctgccatgcccgtaccgacagccccagcagcgtaagcgtctcttccagccagtgcgcatccccggcgctcaactggcaatattcccgcatttcaccactttccaggcggctgttcagcttctgctggcgagcgtactgacgttcacgcgcgctcaccactctggcacgcacgctttcgctgcgttcgccctgaccgcttgcctggctcagcacgccgggcggcggtagcgggatctccagcgacaggtcaaaacgatcaagaaaaggccccgacaatttgcccaaataacgcagcgtctgctccggcgttgagcggttatggttcccctgataatgaccggtcgggctgggattcatcgcagctatgagttgaaagctggcgggataggtcactttggcccgcgtgcgcgaaatatgaatctgaccggattcaaccggctcccgcagtgcatccagtacccggcgctcaaactccggtaattcatcgagaaataaaatgccgttatgagcaagcgagatctcgcccggagcagggatcgtcccgccgcccaccatcgctgttaatgacgcgctgtgatggggggagcggaaaggcctgcgccgccagtgttttttaaggaccgcagcattgaccaggctcagaatagccgcgctttccagggcttcttgattattgagcggcggcaggatcccggtaaggcggctggcgagcatggttttgcctgtaccaggcgggccaatcagcagcaaattatgaccgcccgcagctgtcacttccagcgcacgcttcccctgatcctgaccgatgacgtcgctgagatcgctctctgtcgggaattcgtcattaatggtctgttcaggatggcggagagtagttttcccttccagaaaagcacaaacctccagtaaatgtccggcaaccaggcaatctgatgagccgagtaagctcacttcagcttcgttatcagcagcgacaataatcttcctgcccgctttgatagcctccatcgcggcggaaattgcgccgggaacgccacgcagcgcgcctgtaagcgccagttctcctacaaactcatactggctcagcatagcggtcgtaagctgctcagaagccgccagaagcgcgacagcgataggtaaatcatatcgtccgccttccttgggcagatcggcgggcgcaaggttaatagtgatcttccgtgcggggaactgataaccactgttaatgattgcgctgcgtacccgatcgcgcgcctccttcaccgtggtttccggcagccccaccatcgtcaggccgggaagcccattgctgagatgcacttccaccgtaatcagcggtgccgtcacccctaatgctgcgcgtgtgtagataactgacaatgacatgatccctccttgagaggtgattatgtccggagcaatttgttgcggcacctggcaaaaccgtatcctgcgcggcgcattcagcacatttttattcgttaccgtttttgcactttcacgctggaacgcgcctcgcatatatcgctatgcgagccagaagggaagatgatgacgcgacaaattgaattattctcacatgatgatttcgctatataaaacaatggctttttttaaaatcttcggcaggctgaaaaattagcatataaataaatcttgtcttttacgcgctgtctgtgataactctttaggtattccttcgaacaagaagccagaaagtatataaaatgacagcccttctacgagtgattagcctggtcgtgattagcgtggtggtgattattatcccaccgtgcggggctgcacttggacgaggaaaggcttagaaatcaagccttaacgaactaagacccccgcaccgaaaggtccgggggtttttttatgactttaaaacatccacgaggagcaaagaatgagtagtagcataaaattctgttcctcacgatttacgacggggaagtaactatgaatggagcacagtgggtagtacatgctttgcgggcacaaggagttgaaaccgtcttcggttatccgggtggcgcaattatgccggtttacgatgcattgtatgacggcggcgtggaacacctgttgtgccgtcacgagcagggcgcggcgatggcggccatcggttacgcgcgcgccaccggtaaaaccggcgtctgtatcgccacctccggccctggcgcgactaatctgatcaccggcctcgccgatgccttactcgattccgttcccgttgtcgccatcaccggccaggttgctgccccgtttattggtaccgatgcgtttcaggaagtggatgtgattggcttatcgctggcctgcaccaaacacagctttctggtgcagtcgctggatgagctgccgcgcgtaatggcagaagctttccaggttgccagctcgggtcgccccggcccggtattgatcgacatccccaaagacatccagctggcctccggtcatcttgagccgcatttctctaccgttgaagcagaagaaaccttcccgcaggacgacgtggagcaggcgcggcagatgctggcgcaggcaaaaaaaccaatgctctacgtcggcggtggcgtgggtatggcgcaggcggttcccgcgctgcgtgactttgctacggctactcaaattccggttgcctgcacgctgaaaggcctgggcgcggttgaggcggattatccgtggtatctcggcatgctgggaatgcacggcaccaaagcggcgaacctggcggtgcaggagtgcgatctgctgatcgccgtgggcgcgcgctttgatgatcgcgtgaccggcaagctgaacacctttgccccacacgccagcgtcattcatatggacatcgatccggcggaaatgaacaagctgcgtcaggcgcatgttgccctgcagggggatttaaccgccttgctgaacgccttacagcagcccctgaatatcaccgaatggcgtgagtacaccgctgatctgcgccgcgaacacgcctggcgttacgaccatcctggcgaggcgatttacgcgccgctgctgttaaagcagttgtccgatcgtaagccaaaagagagcgtggtgaccacggatgtaggccagcaccagatgtggtctgcgcaacatatgacctacagccgcccggagaactttattacctccagcgggctgggaaccatgggctttggcctgccggcggcggtcggggcgcaaatcgcccgtccggatgatacggtgatctgtatctccggtgacggctccttcatgatgaatgttcaggagctgggcaccgtaaaacgcaaacagttgccgctgaagattgtcttactcgataaccagcgcttaggcatggttcgccagtggcagcagctgtttttccaggagcgttacagcgaaaccactctgaccgataaccccgatttcctcatgctggcccgcgcctttggcatccccggccagcacatcacccgtaaagaccaggttgaagcggcgatcgacaccctgctcgcaagcgaagggccttatctgcttcatgtctcaatcgacgaactggaaaacgtctggcctctggtgccgcccggcgccagtaactcacaaatgctggagaaattatcatgatgcaacatcaacttgccgtgcaggcccgctttaatccggaaacattagagcgcgttttacgcgtagtgcgtcatcgtggcttccagatttgtgcgatgaacatggaaaccgccgccgatccgcagaacataaatattgaattgaccgttgccagcccgaggtctgtcgaattactgtttagccagctaagcaaactggtggacgtagctcgcgtcgagctccagcaacgtacaacgacatcacaacaaataagcgcctgagcgcaataggaaagaaaatgacgacgaaaaaagctgattacatttggtccaatggcgagatgattcgttgggaggacgcgaaggttcacgtcatgtcccacgcgttgcactacggtacttccgtcttcgaaggcatccgttgctacgactcgcacaaagggccagtggtgttccgccatcgtgaacacatgcagcgtctgcgtgattcagccaaaatttatcgtttcccggtctctcaaagcgttgatgaactgatggaagcctgccgcgcggtgatccgcaaaaacaacctgaccagcgcctatatccgtccgctggtctttgttggcgatgtcggcatgggcgttaacccgccggaagggtacagcaccgatgtgatcatcgcggccttcccgtggggcgcataccttggcgcagaagcgctggagcagggcattgacgcgatggtctcttcctggaaccgcgtagcgccgaacaccatcccgactgcggcaaaagctggtggtaactatctttcttccctgctggtgggcagcgaagcccgtcgtcacggttatcaggaagggatcgcgctggatgtgaacggctatatctccgaaggcgctggcgaaaacctgtttgaagtgaaggatggcattctgtttaccccgccattcacctcttccgcgctgccgggcattacccgcgatgcgatcatcaaactggcgctggatctgggtatcgaagtgcgcgagcaggtgctgtcccgcgaatccctctacctggctgacgaagtgtttatgtccggcaccgccgccgagatcacgccagtacgcagcgtcgacaaaatccaggtgggcgaaggccgtcgcggtccggtcaccacccgtattcagcaagcattctttggcctctttaccggtgaaaccgaagataaatggggctggctggatcaagttaattcataagcataatgacagggcggcacgtaccgccctgaatacctgacagacgggagtaaataaagcatgcctaagtaccgttccgccaccaccacccatggccgtaatatggccggcgcccgcgcattatggcgcgcgaccggcatgaccgacgacgatttcggcaagccgattattgccgtggtcaactcgtttacgcagttcgtgccgggccacgttcatctgcgcgacctgggtaaactggtcgcagagcagattgaggcctcaggcggcgtcgccaaagagttcaataccatcgcggtagatgatggtatcgccatggggcacgggggcatgctttattcactgccatcacgtgaactgatcgccgactccgtggaatatatggtcaacgcccactgcgccgacgccatggtctgtatttccaactgcgacaaaatcacccccggcatgctgatggcggcattacgtctgaacattccggtgatttttgtttccggcggcccgatggaagccggtaaaaccaaactctccaatcagatcatcaaactggatctggtggatgccatgatccagggcgcagacccgaaagtttccgacgagcagagcgagcaggtcgagcgctccgcctgtccgacctgcggctcctgttccggcatgtttaccgccaactccatgaactgcctgaccgaagcgctcggtctgtcgcagccgggtaacggttccctgctggcgacccatgccgatcgcgaacagctgttcctcaacgccggtaaacgcattgttgaactgaccaaacgctattatgagcaggacgatgaaaccgcgctgccgcgcaatatcgccagcaaagccgcgttcgaaaacgccatgacgctggatatcgctatgggcggctctaccaataccgttctgcacctgctggcggcggcgcaggaagcggaaattgacttcaccatgaccgacatcgacaaactgtcgcgtcatgttccgcagctgtgcaaggttgcccccagcacgcagaaatatcatatggaagacgtccaccgtgcaggcggggtgatcggtattctgggcgagctggatcgcgccgggctgatgcagcgcgacgtgaaaaacgtcctcggtctgacgctggcgcaaaccattgagcagtacgacgtgatggtcacccaggacgactcggtgaaagagatgttccgcgccggtccggcaggcatccgcaccaccaaagccttctcgcagaattgccgctgggatacgctggataacgatcgcgccaacggctgcattcgttctattgaacacgcctacagcctggaaggtggcctggcggtgctgtacggcaacttcgcggaaaacggctgtatcgtgaaaaccgcaggggtggacgacagcaacctgacctttaccggcccggccaaagtctacgaaagccaggacgatgcggtagaagctattcttggcggtaaagtggtggcgggtgatgtggtcgtgatccgctacgaagggccgaaaggcgggccgggtatgcaggaaatgctctatccgaccagcttcctgaaatccatgggtctgggcaaagcctgcgcgctgctcaccgatggccgtttctccggcggcacctccggtctttccatcggccacgtctccccggaagcggccagcggcggcaatattgcgctgatcgaagatggcgacatcatcgccattgatattccgaaccgtgggatccagttgcaggtgagcgatcaggaactggcggcccgtcgtgaagcacaggaagcgcgcggtgctgctgcctggacgccaaaagcccgtgagcgtcaggtttctttcgcgctgcgtgcctacgccagcctcgcgaccagtgcagataaaggcgcagtgcgcgataaatcgaaactgggaggctgattatggccgaagcccaaccgctgtctgccgcccctgacggggcggagtatctccgggcggtgctgcgcgcacctgtctatgaagcggcgcaggtcacgccgctgcaaaaaatggaaaagctctcttcgcggctggataacgtcattctggtgaagcgcgaagatcgccagccggtgcacagcttcaagctgcgcggcgcatacgccatgatggccgggctgacggaagcgcaaaaagcgcagggggtgatcacggcctctgcaggaaatcacgctcagggcgtggccttttcgtcttcgcgtctcggtgtgaaagcgctgatcgtgatgcccgtcgccaccgccgacatcaaagtcgacgcggtacgggcgttcggcggcgaagtgttgctgcacggcgcgaattttgacgaggcgaaagcccgggctatcgaactgtcacagcagcagggttttacctgggtgccgccgtttgatcacccgatggtcatcgccggtcagggcacgctggcgctggagctgctacagcaggacgcgcatatcgaccgcgtctttgtgccggtcggcggcggcgggctggcggcgggtgtggcggtgctgatcaaacaactgatgccgcaaatcaaagtgattgccgttgaagcggaagattccgcgtgcctgaaagccgcgctggacgccgggcatccggttgatttaccgcgcgtcgggttgttcgccgaaggcgtggccgtcaaacgtatcggcgatgaaaccttccgcctgtgtcaggaatatctggatgacatcatcaccgtcgacagcgatgccatttgcgcggcgatgaaagatctgttcgaagatgtacgtgcggtggcagagccgtccggcgcgctggcgctggcggggatgaaaaaatacatcgcgcagcaccatattcgcggtgaacgtctggcgcatgtgctgtccggcgcgaacgtcaatttccacggtttgcgttacgtttccgaacgttgcgagctgggggaacagcgtgaagccctgctggcggtgaccatcccggaaaccaagggcagcttcctgaaattctgccagctgctgggcggacgtgcggtaacggagttcaactaccggtttgccgatgccaaagatgcctgtatttttgtcggcgtgcgcttaagccgtgggctggaggagcgcaaagaaattctcgcgctgctgaatgacggcggttacagcgtggtggatctgtctgacgatgagatggcgaaactgcacgtgcgctatatggtcggcggtcgcccgtcgaaaccgcttaaggaacggctttacagctttgagttcccggaatcccccggcgcgctgctgaaattcctgcacacgctggggacgtactggaacatctcgctgttccactaccgcagccacggcaccgactatggccgcgtgctggcggcctttgagctgggcgagcatgaacccgatttcgaaacgcgcctgaacgaactgggttacgagtgtcacgacgaaacccacaacccggcgtttcggtttttcctcgcgggctaatgtgtcgaggtgcctgatggcgctgcgcttatcaggcctacaggggtgtaaaacggtaaatcgcagaaaacgtaggccggataaggcccttgcgccgccatccggcgaaacccacgcgccagacagtaaatcgcaggccggataaggtgcccgcgccgccatccggcaaaatctatgcgcccggcaaaatagaccagaacgcattcaccagcggctcatgcagccgctttttttgtgcgcacacgcccagctcgaacggcgttctctcatcgctgcgctccaggatcatcacgcggttacgcaccggctccgggctgttttccagcaccacctccgggatcagcgccacgccgcagcccagcgccaccatcgataccatcgcctcatgcccgcccaccgtggcgtaaatcgacggattactgattttttgccgacggaaccacagttcaatacgacgacgcaccggtccctgatcgggcatgataaaaggcaccgtcgaccagtccggctcggcaacggacacctgattgcgcaccgggcagggcagcgccggggcgatcagcaccaccgccagattttccagcattgaaaaggccaccgcgccgggcagcgtttccggtttgcccgcaatcgccagatccgcctcgccggtgaccactttgtccatcgcgtcggcggcatcgccggtggtcagcttgatttccacggacgggtgttcggcgcgaaaacggtcgaggatcggcggcagatggctgtaggccgccgttaccgaacaaaacagcttaagctcgccggacagcgatggcccctgctgatcgatggtgtggcgcaactgctgatactgcaacagcgtatgctgcgcgaaggtacgcagctcttcccccgcttcggtcagcgtcacggtgcggttatcgcgcacaaacagcggctgccccaggtcttcctccagacgctggatctgccgggaaagggtggaaggactgacgtgcatggcgcgcgcgctgcggccaaaatgacggctttccgccagatgcaggaagattttcagatcgcgtaaatccatcgggtcagctccagatttttacgttgcgaattatgcaacgtgacgttgttaatatatcaatttcagcaacgcatttcctgtcatatagtgggttcattctcgcaataacgcgaaccgaataataagtacgacacaacatcacgaggatcgaccatggctaactacttcaatacactgaacctgcgccagcagctggcgcaactgggcaaatgtcgctttatgggccgcgatgaattcgctgacggcgcaagcttcctccagggtaaaaaagtggtcatcgtcggttgtggcgcgcagggtctgaaccagggcctgaacatgcgtgactccggtctggatatctcctacgcgctgcgtgccgaagccattgctgaaaaacgcgcctcgtggcgtaaagcgaccgaaaacggctttaaagtcggtacttacgaagagctgataccgcaggcggatctggtggttaacctgacgccggacaaacagcactccgacgtggtgcgttccgtacagccgctgatgaaagacggcgctgcgctgggctattcccacggcttcaacatcgtggaagtgggcgagcagatccgtaaagacattaccgtggtgatggtggcgccgaaatgtccgggtacggaagtgcgcgaagagtacaaacgtggtttcggcgtaccgacgctgatcgccgtgcacccggaaaacgatccgaaaggcgaaggcatggcgattgctaaagcctgggccgcagcaaccggcggtcaccgtgcgggcgtgctggaatcctctttcgtggcggaagtgaaatctgacctgatgggcgagcagaccattctgtgcggtatgttgcaggctggctctctgctgtgctttgacaagctggtggaagagggcaccgacccggcatacgcagaaaaactgatccagttcggctgggaaaccatcaccgaagcactgaagcagggcggtatcaccctgatgatggatcgcctgtccaacccggcgaaagtgcgtgcgtatgcgctgtctgaacagctgaaaaccattatggcgccgctgttcaaaaaacatatggatgacatcatctccggtgaattctcctccggcatgatggctgactgggccgaagacgataagaaactgctgacctggcgcgaagagaccggtaaaaccgcctttgaaactgcgccgcagtttgaaggcaaaatcgccgagcaggaatacttcgacaaaggcgtgctgatgatcgcgatggtgaaagcgggcgttgagctggcgttcgaaaccatggtggattccggcatcatcgaagaatccgcgtactacgaatcgctgcacgagctgccgctgatcgctaacaccatcgcccgtaagcgtctgtatgaaatgaacgtggtgatctccgataccgccgagtacggtaactacctgttctcttatgcctgcgtgccgctgctgaaagagtttatgaccacgctgcaaccgggcgatctgggcaaggcgattgaagggactgcggtggataacgcccagttacgcgacgtgaacgaagcgatccgcagccacgccattgaggcggtcggtaagaaactgcgcggttatatgacggatatgaagcgtattgccgtcgccggttaataacaccctatagcgttactgtaggcccggtaagcgccagcgccaccgggctttattaagcactaaatgtaggcccggtaagcgtcagcgccaccgggctttttatcagttgcggtacagcactttaatgatgtggtagccgaactgggtgtgcagcgggccggttggctccagcaccgggcaggagaacaccactttatcgaaggccggaaccatctggccctgacggaattcacctaaatgaccgccttttttacctgacgggcaggtagagtgttttttcgccagcttctcgaaatcgccgccgtttttgatctgttccagaagatctaacgccagtttctcttctttaacaaggatatgcattgctgccgctgtttttgccatgatcgtgccttgagtcagatagtttacgctcgctatactaccacgcgtttttatcccctcctgcctttcattgagtgattttcttatgcgtttgaaccccggacaacaacaagccgtcgaatttgtcaccggaccctgtctggtgctggcgggggccggctccggcaaaacccgtgtgatcaccaataagatcgcgcacctgatccgtggctgcggttatcaggcgcgacacatcgcggcggtaacctttaccaataaagccgcgcgggaaatgaaagagcgtgtcgggcagacgctgggacgtaaagaggcgcgcggcctgatgatctccaccttccatacgctggggctggatatcatcaagcgggaattcgcggcgctcggcatgaagtccaacttttccctgtttgacgacaccgaccaggtggcgctgctcaaagatctgaccgaggggctgatcgatgacgataaagtggtgctgcaacagctgatctcgacgatctctaactggaaaaacgatctttgcacgcccgcgcaggcagcggctcaggcgaaaggcgagcgggatcgtatcttcgcccactgctacggcctgtacgacgcgcacatgaaagcctgtaacgtgctcgattttgacgatctgatcctgctgccgacgctgctgctgcagcgcaatgaagaggttcgcgagcgctggcagaacaagatccgctatctgctggtggatgaatatcaggacaccaacaccagccagtacgagctggtaaaactactggtaggcagccgcgcgcgctttaccgtggtgggggatgatgaccagtcgatctactcctggcgcggggcgcggccgcaaaacctggtgctgttaagccaggatttccccgctttacaggtgatcaagctggagcagaattaccgctcatccggacgcattctgaaagcggcgaacatccttatcgccaataacccgcacgtgtttgaaaagcggctgttctccgaactgggctacggcaccgagctgaaagtgctgacggccaataatgaagatcacgaagcggagcgcgtcaccggcgagctgattgcacatcacttcatccagaaaacgcagtacaaagattacgccattctctatcgcggtaatcatcagtcccgcgtgttcgaaaaattccttatgcagaaccgcattccgtaccgcatctccggcggcacgtcgtttttctcacgtccggaaatcaaagatctgctcgcttatctgcgcgtgctgaccaataccgacgacgacagcgctttcctgcgcattgtgaacacgccgaagcgggaaattggctctgctaccctccagaagctgggcgagtgggccaacacgcgcaacaaaagcctgttcgccgccagcttcgacatgggcctgacccagacgctgaccgggcgcgggtatgaatcgctgacccgctttacccactggctgggtgaagtgcagcgcctgtccgagcgcgatcccatcgcggcggtgcgcgatctgatccacggcatcaactatgaatcctggctgtatgaaacctcacccagcccgaaagccgctgaaatgcgcatgaaaaacgtcaacacgctgttcagctggatgacggaaatgctcgaaggtagcgatattgatgagccgatgaccctgacgcaggtggtgacgcgctttaccctgcgcgacatgatggagcgcggcgaaagcgatgaagagtccgaccaggtgcagctgatgacgctgcacgcctcgaaaggtctggagtttccgtacgtgtttatggtgggaatggaagaaggcttcctgccgcaccagagcagcattgatgaagacaatatcgaagaagagcgccgcctggcctatgttggcatcacccgcgcgcaaaaggagctgaccttcacgctgtgcaaagagcgtcgtcagtacggcgaactggtgcgcccggagccgagccgttttctgctcgaactgccgcaggacgatgtgatctgggagcaggagcgcaaagtggtcagcgccgaagagcggatgcacaaaggccaggcgaacctggccagtatcaaagcgatgctggcaaaatcgaaagcgaaataatccctccgcctgtgcagagggatcaatcacacggttactgctgccccgcccacaccaccatcactttatcgtcgcccgcttcacgggtaaaaccatagccctgcggcatggaaagcgtggtttgcttacccatgccgatagccggatggcgggcgcggaactgccccagccgctgccagtgggcgacacgcggcgcagcgctgccggtcacatcctgccagttcatatccgaacgcgtgccctggagcggatccgagccggtgggtccgaacggtcgtccggactcgtcgccgtaaaaaatctgcaccgcgccgggcgtcagcaacagcagttcagccgcccgctgatccgcttcgcggaacagccgcgtatcgtgggatgacaaataactcagcacgttaaaacgctgtagcttgtcggccatctgctgccacgtcagatcgatgctggcgaagcaatccgccgctttcgccgcctgctcctgataatcaaaattgatcatcgcatcgaatccatgacggtaatagctgctctccatgacgccgtggccccaggcttcgccggtcatccagaaaggcgcgtcatcgcgttttttctgcgggttggcctgcttccactctgccagcgcttgagtcgcctgggttttcaactgctgtaaggtggccatatccacatgcttggcggtatcgacacggaaaccgtcaatgccgtactcccgcacccagtcgctcagccagcgggtgaggtaatcacgcggcgtgaagccgtcgatagctttcgcgcgggtatccggcttgtgctgataaaacactggcagtccggagggagtggtcgactcggttttcagatccggtaaaaacgccagcgacatggtgagatcgtcgaagccgggattatcgtaatcgccaatatcggtgcgcacccaggctttgccccaccagttttgccaggcgtttttatcgctgaagttgatgtaatcattaaagctgtgccagttctgtccggcggcgggcttccagtctgtccagcgctcgccgagcacttttttacgctcctcgccctgcacatagagcgcgccgaactgatactgctgcatatcggccagggtcgcgtaaccggtatggtttaccaccacgtcaaacaggatgcggatgccgcgctggtgcgcttcatccaccagcgtgcgcagatccgcttcgctgcccatgttggcatcaagcatcgtccagtcctggatgtaatagccatgataggcgtaatgcgggaaatcgcctttggtgccgccgcccacccagccgtggatctgctcgaagggcgcgctgatccacagcgcattgacgccgagctgcgagaggtaatccagcttttgcgtcagccctttcagatcgccgccatgaaaagtgccgatctcttccatgccgtctttgtggcggccatagctgttgtcattggccggatcgccgtttacgaaacgatcggtcagcacaaaatagacggtggcgttatgccagtcgaagggcgcggtggcgtcggtttccgcgcgctcaagcagcagcagaccgtcactgttcgcatcgggcagcagggtgatttttccctgtttgaccgtggcggtttgctgactgtagaaatcgcgcaccacgctgccttcggcaaaggttttactgacgtccagggtaaggggtttgccgtcccatttcggacactggcgcgttaccgctgcggcgctggtctgcggcgcgctcttcaccgtcagcatcaatgttggcgtaccggaacgggtatccagttgcagctgataatcgccatcgcggaacacacgccactgcggcggcgtaccggaacagggctgcaaagagagcatttggttgagtcttggcgtatcgactggctgccagcactgttgatcaagcttcagggttaacggataagcgccttttttcagcggcgcgtcgctgcgataaacccccgatccggcatcgctaaaggcggggaaaccgggggatgtccagtctgaccaggccaccgtgggcagcagcaataataggagggctgaacgtttcattcggggttcctgtcggatgatttttgcccagtgtgccagaagaggctggcgggtaactcatcccgatgagcgcttacgcaggggtgaggcgaaagggtgagtgatctgcttcaaaaaacggcaacaatttgcgataaacgctgcatttcgtgcataatttatacgctgaaacggattagctgatgacacgcattcggaaatcgcttattcattgtgtgtcaataaaagggtatttttgatatgatttgagattccgctctcaaaattgtgaatcaaataaggtgttggaatgcaacaatccgacctggagacctgatgataacgactcccatacgacgatatggggtaacgattctaatgtttctcaccctggtattttccggtgaggtgcttgccaagacgcacgaaaaaacagcgagtcataaaaccccgataaccaaacagataagtaagaagcaggctagcagtaaacaagagtattctcgcaatagtgcaaagagtagttcacttcctgatttgcgaaaatacccttccgggacaccaagaaaaaaagcgtttctccggacggtcatgccttatattacgagtcaaaacgcaacgatcgccgctgaacgtaactggttgatgtcaaaacagtacgaaagccagtggtcgtcggccgagcgcgcgcgcctgaaggatattgccaaacgctataaagtgaactggtcgggcaatacccgccgtattccgtggaatacgctgctggatcgcgtcgacatcattccggacagcatggtggcgaccatggccgcagcagaaagcggctggggaacctctaagctggcgcgtagcaacaataacctgttcggcatgaagtgcatgaaaggtcactgtacgaacgcgcccggcaaggtgaaaggctactcccagtttgcttcggtgaaagagtcagtgaacgcctacgtggttaacctgaatacgcacccggcgtataagtcgttccgtaagtcccgcgcgcagctgcgcaaagcggaccaggaagtgacggcgagcaatatgatccataagctcaaaggctattccacgcagggcaagcgctacaacaactatctgtttgccatgtatcaggacaatcagcgactgattgccgcccacatgtaaacgaaaacgccttccagccggaaggcgttttttttcgtcaggcaataacggctacatcatcacttcactgtaccggtcccggtaatctttcggcgtggtgtcgtactccttcctgaataccgaatagaaatactgcaacgacggataaccgcacatctgtgagatctcgttaatggacagcgaggtggaaatcagcaggctgcgggctttctccagtttttcagcgtggatcaccgcgtgaatggtttcaccgacttcctctttaaagcgcttttccagattcgatcgggaaatgccgaccgcgtccaacacctgatccaccttgatccctttgcaggcgtgattgcggatatagtgcatggcctggatcaccgcgggatcgctcagcgatcggtaatccgtcgaacgccgctccaccacgcgcaccggcggcaccagcaatcgctgtaacggcaatggctcattatccagcagacggtgcagtagtttcgctgcctgatagcccatttgccgtgttccctgcgccactgacgagagtgccacgcgcgacagataacgcgtcagctcttcgttatcaataccgatcacgcacagtttttccggcacaggaatatgcagatgctcgcacacctgcaagacatggcgggcgcgcgcgtcggtgacggcgataatgccggtctgcggcggcagggtttgcagccagtcggccagtcggttttgcgcgtgctgccagttctccggcgcggtttccagcccctgatacaccacgccgcgatatttctcctgcgccaccagctggcagaacgcatactcccgctccaccgcccagcgcttgccgctggaggcgggcaggccgtaaaaggcgaaacgctgtacgcctttctcttttaaatgcaaaaaggcgctttcaaccagcgcatgattatcggtggcgatgtaatgcaccggcggatagttatccgcccgatggtacgaaccgcccacgccgacgatgggcacattaaccccggccagcaaccgctggatctcgtcgtcatcgtagtcagcgataacgccatcccccagccattcgcggatattgtcgatacgggtgcgaaaatcttcctcaataaaaatatcccactcggactgcgacgcctgcaaatattcacccacgccttcgacaacctggcggtcataggctttattggcattgaataacaacgtaatgcggtggcgcttttcaaacatgttggtctcttattcagtagaacactacgtctgcttaccacattcagcacactgccggaaaaatttcctccggcagtgtgatcatccctgagatttcattaccttatgcgcgacgtttggtggcggaatccatccataccgccagcaacaaaatcgcccctttcacgatgtactgccagaacgtcggcacgtccatcatgctcataccattatccagtgacgccataatgaacgcccccatcaccgcacccgccacgctgccaataccgccagccaggctggtgccgccgatcacacaggcagcgatggcatcaagctctgcgatgttgcccgctgaaggcgaaccggcccccagtcgtgaactcaggatcaaaccggcgatagccaccatcaggccgttgatggcgaacaccgccagcttagtgcgctccacgttaataccggaaaggcgcgccgcctcgatgttgccgccgatggcatagatgcggcggccaaaggcggtgcgtgtcgccataaacattccggcgagcagcaggaaggtgaggatcagcaccggcgtcggcacgccacggtaatcgttcagcagccagatggcccccagcacgatcactgcaatcagcgcctggcggcccacgactgaagacgacgcgccagcgctaagtcccagcgcctggcggcgcatccgtccgcgccactgccatagcgtgaaagcaaccagccccagcgcgccgacgccaaagccgacgacgtccggcagatagctttgaccaatctgcgacatggcagcgctggtgggcgacacggtggtaccgttggtgatgccgatcagcacgccgcgaaaggcgagcatcccggcgagggtgacgataaacgacggcactttacggtacgccacccaccagccgttccaggtaccgagcagcaggcccagcaccagcgttaccacaatggtcagcggcagcggccagcccagccagacgtcgaaaatggccgccacgccgcccagcagccccatcatcgagccgaccgagagatcgatctccgcggaaataatcacaaacaccatgcccaccgccagaatgccggtgatcgccgtctggcgcagcaggttggagacattacgcgcgctcaggtacgagccgtcggtcatccaggtgaaaaacagcatgatcaccactatcgcggcaatcatcacgaatacctgcaaattcagtgatttcagtccgccgaaggtaacaggctgcggcgcggacaccttgagttcagatgggttggttttcgacatgatgttcgctcctcagcgccgcttccataacctgttcctgggtcagatgatgattgatgagattggccttaagcctgccttcgtgcatgaccagcacccgatcgctgaggcccagcacttccggaagctccgatgaaatgacaatgacggcgatgccctgttgcacaagctgattgataagtttgtagatctcgtatttcgcgccaatatcaatgccgcgcgtgggttcatcgaggatcaaaatgcgcgggttgagcagcagacagcgcgccagaatcgccttctgctgattgccgccgctcaggcggccaatcgccagctccggcgaggaggttttcaccttcagccgtgccagtgactgcaaaatacattgctgctcggcggcatcgtcgaggctggtgagcgggccggaaaactgatccagcgcggcgagggtgatatttttacccaccgccatcaccggcacgatgccgtcttttttgcggtcttccggcaccatcgcaatgccgtggcgaatggcttcctgacagttacggatctgcaccggctgaccatcaataaatacccgtccttcatgacgccccggccagacgccaaacaggcactggaccgcttcggtacgcccggcgccgaccagcccggcgatgcctaaaatctcgccgcgcttaagggaaaaggagacgtcgttgacgcgcttaatatgccggttgaccggatgccaggcggtcagatgctcgacgcgcaggatctcgtcgccggtagtatggggttcattcgggtaaagggcggtcagttcgcgaccgaccatcatggtgataatgtcatcctcactcattccggcagcctcgcgggtgccgatatgctgcccgtcgcggatcacgcagataacgtctgaaatggctttcacttcattcagcttgtgcgagatatagatgcaggcgatgccgtggtgttgcagatcgcgaataatatcaagcagcaccgcggtttcctgctccgtcagcgaggcagtaggctcgtcgaggatcaacaggcgcacctgcttgttcagcgccttggcgatctccaccagttgctgctgcccgagacccaggtcgcccacacgggtatcgggagaaatggcgaggctgacctgcgccagtaatttctggcagcgcagcgtcatagtgtcgtaatccatcaccccgtgatgggtgatttcggcaccgaggaagatattttccagcacggtgaggtgtttcaccagcgccagttcctgatgaataatggcgatgcctttgcgctctgtatcgcgaatatggctggcctcgatcgtttcgcccgcaaaaacgatgtcgccgtcatagctgccaaagggataaatcccgcacagcactttcatcagggtggatttaccggaaccattctcgccgcacagggacaatacttctccggcgttcagttgcaggctgacattatccacggctttcactgcgccaaaggccttggtaatgtttttcatctcaagtaaataaggcatacccgctccgcataaggccaaggataacagtatttgaaacgcttccccgtaccggacggggaagcgcacaaagattacagctggctcttttgatggaatccgtctttgatgacagtggcgtcgatattgtctttattcacttcgattggcgtcagcaggcgggcgggcacatctttcagtccgttgttcagcgtggcatcagccttaggcgttttgccgttacccagttcgacagcgatctccgcagcggtgttcgccagttgggtgatcggcttatagacggtcatcgtctggctgccgttgataatgcgtttgaccccggcgagatccgcatcctggcctgaaatcgccactttacccgccagaccctgcgcactcagcgcctggatcgcgccgcccgccgtggcgtcgttcgaggcgactaccgcatcaattttgttattgttggcggtcagcgcgttttccatgattttgagcgcgttttccggcagccagccgtcagcccactgatcgccgacaattttaatttttccgctgtcgatatagggttttaatactttcatctgaccggcgcggaagagcttggcgttattatccaccggtgagccgcccatcaggaaataattgccctggggcactttttctaccaggctttgcgcctgaagttcgccgactttttcattatcaaaggaaatatagaaatcgatgtcagcattattaatcatgcgatcgtaggctaatacttttatgccttcctgcttcgcttcttttacgacgttacttaatacctgaccgttgtaaggaataataaccagcacatcaacgccgcggttgatcatattttcaatctgcgacatctgggtttcttcgttgccattcgcagactgcacaaatacttcggcacctaaggattcggcttttttaacaaaaatatcgcgatctttctgccagcgctccagacgcaggtcatcaatggccataccgattttaatctctttcgcctgcccggcaaaggtggcgagcagcagggaagcgcagactgtaaggcaaaggttctttatcttcataatagtaatacctttttgtagggttatagggcctgagataaaagaaacatgcaggatccagacgcagcaaattcttaacgcggaatcaaaacctggcaattactgatttttatcctggcgttacgatatttggtttatttgctaatttatgaccgcgatctgattttaatcttcccgggtattagattttgcagaaaattggaaggcgcgccgcaaggtaacctgtagacatttattttgggagccagcgcacgtttgtgcattatctcaatagcagtgtgaaataacgtaattgagccaggcgctgagaggatccagtattaacgcagcaacgaacactcgccgcatacattgattatggagctgattatgcaagcctatttcgaccaacttgaacgtgtacgctacgaaggtacccaatccaccaatccgttagccttccgccactacaatccggacgagctggttctgggcaagcgcatggaagatcatctgcgtttcgccgcctgttactggcacaccttctgctggaacggctctgatatgtttggcgtgggagcctttgaacgcccctggcagcaggcgggcgatgcgcttgagctggcaaaacgtaaagccgatgtggcctttgagtttttccacaaactgaatgtgccttactactgcttccatgatgtcgacgtctcgccggaaggcgcatcgctgaaagagtatctgaacaattttgcgaaaatgaccgacgtgctggcgcaaaaacagcaggagagcggcgtgaagctgctgtggggcacggcaaactgctttactaatcctcgctacggcgcgggcgcggccaccaacccggatccggaagtgttcagctgggcggccacgcaggtggtgacggcaatgaacgctacccatcaactgggcggtgaaaactatgtgctgtggggtggtcgcgaaggctacgaaaccctgctgaataccgatctgcgccaggagcgcgagcaaattggccgcttcatgcagatggtggtggagcacaaacacaaaatcggcttccagggcactctgctgattgagccaaaaccgcaggagccaaccaagcaccagtacgattacgacgtcgccacggtctacggcttcctcaagcagttcggtctggaaaaagagatcaaagtgaatatcgaagccaaccacgccactctggcggggcacaccttccaccacgagatcgcctccgccatcgcgctgggcatctttggctctgtggatgctaaccgtggcgatccacagctgggctgggataccgaccagttcccgaacagcgttgaagagaacgcgctggtgatgtatgaaatcgtcaaagcgggcggttttaccaccggtggtctgaactttgacgccaaaatccgccgccagagcaccgacaaatacgatctgttctacggtcatattggcgcgatggacaccatggcgctggcgctgaaagtggcggcgcgcatgattgaaagcggcgaactggataagcgcgtggcgaagcgttacgcaggctggaacggtgagctgggtcaacagatcctgaaaggacagctgtcgctggcggaactggcgaagcacgctgagcaacaaaacctggcgccgcagcaccagagcggccatcaggaactgctggaaaatctcgttaaccgttatctgtttggttagcaaaccctgagcgccacgtccgtcgtggcgctccgatcacagcctgtacaggagcagtcattatgtacatcggtatcgacctcggcacctcgggcgtaaaagcgatcctgctgggcgagcagggtaacgtgcttgcctcttacaccgagtcgctgacggtttcacgcccgcatccactctggtccgagcaggatcccgaacagtggtggctggcgacggatcgcgcaatcaaaggcctcggcgcacagcatccgctggcccaggtaaaagccgtggggatcgccgggcagatgcacggcgccaccctgcttgataaacaggacgttatcctgcgtccggcgattttatggaacgatggccgctgcggtgaagagtgcgcgctgcttgaagcccaggtgccggactcgcgcgccattaccggcaatctgatgatgcccggttttaccgcgccaaaactgctgtgggtgaagcgtcacgaaccggacgtgttcgcccgcgtggcgaaagtattactgcctaaagattacctgcgtctgcgcatgaccggcgagtacgccagcgatatgtccgatgcggcaggcaccctgtggctggacgtcgcgaagcgtgactggagcgataccctgctggcagcctgcggactgacccgcgaccagatgcccgcgctgtttgaaggcagcgccattaccggcagtctgttgcctgaggtggcgcaggcctggggattacccgccgtgccggtggtggctggcggaggcgataacgccgccggtgccgtgggcgttggcatgatcgatgcgggccaggcgatgctctccctcggcacctccggcgtctattttgccgtcagcgatggctttctgagtaaaccggaaagcgccgtgcacagtttctgccacgcgctgccggaacgctggcatttaatgtccgtgatgctgagcgccgcctcctgtctcgactgggcggcgaagctgaccggcctgtcctcggtggcggaactgattaacgccgcgcagcaggcggataagaacgccggtgacctctggtttctgccgtatctctccggcgagcgcacgccgcataacaacccgcaggcgaaaggcgtcttttttggtctgacccatcagcacgggcagaacgaactggcgcgcgctgtgctggaaggcgtcggctacgcgctggcggacggcatggatgtggtgcatgcctgtggcatcacgccgcaaagcgtcacgctgattggcggcggagcgcgcagcccttactggcggcagatgctggcggatatcagcggtcagcagctggattaccgcaccggcggcgatgtcggtccggcgctcggcgcggcaaggctggcgcagatcgcccttaacccggatcgggcgctgtccgatctgctgccgccgttgccgctggagcaggcgcatctgccggatgccgcgcgccacgcgcattacgcaccgcgccgggaaaccttccgccgcatctaccagcagcttctgccgttgatgtcgtgaaagcaggccgtccgcgaacggcctgatgatgtccttttctggtattagcaaacgcaggacgccttgtcagaatggcagtacacccactgcacaaggcgtcctgaaatgacccgtaccgcgcttatcaatatcgatacccaacaatccttcccgcaaaaagatttctggcaggaggaggagtagttgcctgcatttcaggaggcaatgctccgtctggtggcggcggatctgggctaccgcgtgacctttgtcagcgaagcgacgttaaccttcccgatgacgcataatggcattacgctggacagcgcaacgctgcgtcaccgcacggaaaccgtgctggtggatcgctttgccgccattaaaaccgtaacccaaacgctggagtcgcttgcatgagtgtggatgtctggttcgtgatgctgccgggggtgctggcgctggatatgaccggcccggcagaaacctttgcgctggcgggcaatgcgttccgcctgcatttcatcgggccggacgccgaggtgccgacctctgtcggcgtgaccatgggcaatatcgcgccgctgcccgacacgctgccggatggcagtctgctggtgcttcccggcgtgtcagactcctcacgctatttcgccacaccgcaggccgaccgtgtttgtcactggttgatgcgccagcagccgctgatccacagccagaacatcaccctgatgtgcgtctgttccggctccctgctggcggcgaaagccgggctgatgcaggggatcacctgcaccacacaccacgatgtgatcgcccggctgaaggccgccgcgccgacggcgcaggtgaaagagaaccgcatttttattgaagatcgcggcatctggaccagcgccggtatcacctcggggattgatttaaccctgcacctgattaaccgcctgtgcgggccggaaacggcgctggccgtggcgcgggagatggtggtgtggtttcgccgctcgggggacgatccacagctgtcgccctggttgcgctatcgtaatcatctgcatccggcgatccaccgggcgcaggatgcgttaacgaatgcacctgaaaaagcctggtcgctggtggacattgccgcctgtgcgcacgtcagcccgcgtcacctgacgcggctgttccagcaacatctgggcatcagcgtgcgcgactacctggaacagctgcggctggcggtggcggagcagtggctggtgcaggggcgcggtgtcgaacacgcgtcgcaggccgcgggattttcctctccgcggcagctgcaccgcgcccgccagcgggccatcagctgacaaagcgacggctatcgaggcgctgcaacagcatcgacagcgctaaactgcataccagcgcggcggcgaagatccacagcatatccagcagcggcgagctttttatctccaccccgcgcgtgcgtaacgcatgaataatcagcgcgtgaaagccgtaaatgcctaatgaatgccgcgagatcagccccagacccggcagaacgcgggtattgagcgtgtttttcaccagcgtaagcaggctgatggcgcagataaacaccatcgggccgcaatagtgataccaggtatcggcgaaattaccgcgccagcgcagttcatgcagcgtgccgcgcgaaatgacaaacactgcggcaataaacagcgccgcgcacagcccgctcacatatttgcgctgcgtatccatcatgccgagggcgcgcccgagaatgccgtacagcacgtagtaaaaggtatcgccgttgatgtacagattcaccggcagccattccacgccgccggttttcagcgacagggtattagggttggcgactacgccaatcaccacggtcagcgccagcagcattttgccgctcacgcttttcacctggatcagcggcgacagcaggtaaatcacaatgatggcgaagaaaaaccacaggtgataaaacaccggcttttgcagcaggtttctcagcgacagctcgccgtttatcgaggtaaaaaacgtaatatagagaaacgccaccagactgtagaacagcaggcagaggccgatgcgcaaaaaatggcgcggctgcgcgctgcgttcaccaaagaacagatagcctgaaatcataaaaaacagcggtacgctgacccgcgacgcggaattgaggatattggccatatcccagtacagtgggctgacgctctgcgcgttggtgatataccagctggtggtgtggatcatcacgaccatcaggcaggcgatgccccgcagattgtctatccagttaatttttgactgcattcgttccccgatttccgtcttaaacaggctctgactcgcgattgccagcgtgttctcactggataattccgagtttcccggcttgcgcttgtacctgccatgctgtgtttgcaatatatttaacagcgcaatcagcctgctccctcttattaaaaataatagccagataacatggcggcgataaaaatgatgatgaagtatgtatttccagcattattactcttactgaccggctgtagcagccctgacgggcagagcgtacaaaaagcgcagcaggcgaaggtcagcccggcccgctcgttgtccatggagcaactgtgcaaagagaacgccgctcaccgctataataccggggcgcagaatattgcagtcaccggctttgtacaatttcaggcgagttatgaagtgcgcggctatacgccccgtgaagaacgttttgtttgcgctttcgatcccgacggtcagtttttgcacctttccatgcgctaaggccacgccacaaacccaattttccctaaacaaccccgtttcgtactgtatatcttgcggtcaacgggtatactggcgacttccttaaatccaccgtatccagcacgaaatattatgcaaaagtttgataccaggaccttccagggcctgatcctgaccttacaggattactgggctcgccagggctgcaccattgttcaaccattggacatggaagtgggcgccggcacctcacacccgatgacctgcctgcgcgcgctggggccagagcctatggcgaccgcctatgtgcagccttcccgccgtccgaccgatggtcgctatggcgaaaacccgaaccgcttacagcattactaccagtttcaggtggtcattaagccgtctccggacaatatccaggagctgtacctcggttccctgaaagaactgggtatggatccgaccatccatgacattcgcttcgtcgaagataactgggaaaacccgacgctgggcgcctggggtctgggctgggaagtgtggctgaacggcatggaagtgacgcagttcacttacttccagcaggtgggcggtctggaatgcaaaccggttaccggtgagatcacctacggcctggaacgtctggccatgtacattcagggcgtggacagcgtttacgacctggtctggagcgacggcccgctgggtaaaaccacctacggcgacgtgttccatcagaacgaagtggaacagtccacttataacttcgaatacgctgacgtcgatttccttttcacctgcttcgagcagtatgaaaaagaagcgcagcagctgctggcgctggaaaccccgctgccgctgcctgcttacgagcgcattctgaaggccgcccacagctttaacttgctggatgcgcgcaaagccatctccgtgactgaacgtcagcgttacattttgcgtattcgcacgctgaccaaagccgttgcagaggcttattacgcgtcccgtgaagcccttggcttcccgatgtgcaaccgaaataaataagaggcggccatgtctgaaaaaacttttctcgtggaactcggcactgaagagctgccaccaaaagccctgcgcagcctggcggaatcctttgctgcgaacgtgacggcggaactggatgccgcgggcatcgcccacggtaacgtggagtggttcgccgccccgcgccgtctggcgctgaaaatcgccagcctcgcggcggcgcagccggatcgtgaagttgaaaaacgtggcccggcgattgctcaggcctttgatgcggaaggtaaaccgagcaaagcggctgaaggctgggcgcgcggctgcggcatcaccgttgatcaggcggagcgtctgaccaccgataaaggcgaatggctgctttatcgtgcccatgtgaaaggcgaaagcgtgcagacgctgctgccgaacatgattgcgacctcccttgctaaactgccgatcccgaaactgatgcgctggggcgcaagcgacgtacacttcgtgcgtccggttcataccctgactctgctgctgggggatgaagtgatcccggcgacgatcctcggtatcacctccgatcgcgtgatccgcggccaccgctttatgggcgagccggaattcaccatcgacaatgccgatcagtatccgcagatcctgctggagcgcggcaaagtgatggcggattacgaagcccgtaaagccaaaattaaagcggacgctgaagaagcggcgcgtaagattggcggcattgccgatctcagcgaaagcctgctggaagaagtggcctcgctggtggaatggccggtggtgctgaccgcgaaattcgaagagaaattcctcgccgtaccgtccgaagcgctggtgtacaccatgaagggtgaccagaaatacttcccggtttacgcggcggacggcaaactgctgccgaacttcatctttgtggcgaacatcgagtccagcgatccgcagcaaattatttccggtaacgagaaagtggtgcgtccgcgtctggcggatgcggaattcttctttaataccgaccgtaaaaagcgcctggaagataatctgccgcgtctgcaaaccgtactgttccagcaacagctcggcacgctgcgcgacaaaactgaccgcatcaccgcgctggcgggctggatcgccggtcagattggcgcggatgtcagccatgctgaacgtgccggtctgctctccaagtgcgacctgatgaccaacatggtgtttgagttcaccgacacccagggcgtgatgggcatgcactacgcacgtttcgatggcgaagcggaagacgttgccgtggccctgaaagagcagtatcagccgcgctttgccggtgatgcgctgccgtccaacccggtggcctgcgccgtcgcgattgccgataaaatggacaccctggcgggtatctttggtatcggtcagcatccgaaaggcgacaaagatccgtttgcgctgcgtcgtgccgcgctgggcgtgctgcgtattatcgtcgagaaaaacctttctctcgatctgcaaaccctcaccgaagaagccgtgcgtctgtatggcgataagctgactaacgctaacgttactgacgacgtcatcgactttatgctgggtcgtttccgcgcctggtatcaggatgaaggctacagcgtggataccattcaggcggtgctggcgcgtcgtccgacccgtccggctgatttcgatgcgcgtatgaaggcggtgtcccacttccgtacgctctccgaagcggcggcgctggcggcagccaacaaacgtgtctccaacatcctggcgaaatccagcgagccgctgaacgataacgttcacgcctcggtgctgaaagacgatgcggaaatccgccttgccatgcaggtggcggtgatgcgcgataagctgcagccggtcttcgctgaaggccgttatcaggacgcgttgatcgagctggcctcgctgcgcgagccggtggatgagttctttgaaagcgtgatggtgaatgccgaagacgcgcaggtgcgtatcaaccgcctgacgctgctggcgaagctgcgtgagctgttcctgcaggtcgcggatatttcgctgttgcagtaagtctcattgcccggcggcgcaggcttgccggacctacatttattttgtaggccgggtaagcgtagcgccacccggcacaaaacataaaacccgccatttggcgggtttaaactttcaggaacacctcaggtacaaagtacaaaaaattattccatcaattgcttacttaatcttgggttggcctggagcaggcgcagcaacttcagttcagtcggggagggttttacccttttagactcccattcatgaaccatcgccacgctcacacccattacccgggcaaaatcatcgtttttcagaccggtacctttacgcagctgctcaaactcactgaaaggattaggtttttgattcaacgtgatagtttgttgcgatacatcgtgtttaaagacaatttgttccagactgctaagcagttcaaacataggatctttatattccattgagaactcctcataaatcacaaggcgtgatcgtaaacgacaacgagccatttaagagtagtcggtaaatattattctggatggttgcgagagtgattaattgtcaggtaatggacctttatatactaaaaataccttttttcttgtccaggctctctttaatgccttgatcattaagccctggtttttagctgtagacttttgtaaatgatcagcaaaaaaaatactaagcattgccggtacgcactaagcgtagcgggggccgcagagcaattccgatgcggggctttccctgacaagaatgtcaggaaagggtatcttgcaaagccgacctggactatccttgtcagcgtcgggcacgtgtgtgccggtgtgcgcttttttgggtgaaaggagtaataaaatggcgacaggaaagtcctgctctcgctggtttgcgcctcttgcggcgttattaatggtggttagcctgagtgggtgttttgataaagaaggcgatcagcgcaaggcgtttatcgattttctgcaaaatacagtgatgcgcagcggtgagcgtttgcctaccctgaccgcggatcagaaaaaacagtttggtccctttgtatcggattacgccattctttatggttattcccagcaggtgaatcaggcgatggacgcgggtctgcgtccggttgtagacagcgtgaatgccattcgcgtgccgcaggattacatgacccagcgcgaaccgctgcgtcaggcaaacgggtcgttaggcgtgctgagccagcagttgcagaatgcaaaaatgcaggcggattcttctcgtgccgcgctgaaacaggccgatgatttgaagccggtttatgaccaggcttatcaaaaagtggttaccgcgccgtcaaacgcgctgcaaccgctgatcccggctgcacaaatctttacgcagcaactggttcaggtgggtgattttattgcccagcaggacacacaggtgagctttgttgctaacgggatccagttcccgacttcccagcaggccagccagtataactcgctgattgggccgctggcgtcgcagcatcaggcgtttacacaagcctggaccgctgccgttaacgcgacgcaataagcgtttcgtccccccgccaaaaagcggggggatccgccgcttcgctgaggccctggccttgtggacggctgaaataagtcttgctaagcctccgggataatgcgttaatgctccccggtttgacgtacagacctaaagcactttataaagcagtccctccaggagttatccatagatacccttcgttgagagctttcctttatcgcttaaaatctgtaaagcacgccgtagcgccggaaggcaaacttaattaaaaaggtaatctctatgtctggtaaaatgactggtctggtaaaatggttcaactctgacaaaggcttcggcttcatcactcctgacgatggctctaaagatgtgttcgtacacttctctgctatccagaacgatggctacaaatcccttgatgaaggccagaaagtgtccttcaccatcgaaagcggcgctaaaggcccgtctgctggtaacgttgtaagcctgtaatcgcttccgtttaaagcacgctttctaaaaaaaaccccgccatgcggggttttttcttttctggcttccggctatttcgcgatctgcggattcacacagtttttctctactttgccattgagcgcgtcgatcagattatccaccgcgcaggcggccatgttgtaacgcgtttcaaaggtggcggaaccgatatgcggcagggcgaccacgttcggcagcgacagcagttccgaatctgccggcagcggctcctgttcgaaaacgtccagacccgcagcatggatctcgccgttcttcagcgctgcaatcagcgctttctcgtccaccaccgggccacgaccggcgttgataaagatcgccgaggatttcatgcgggcaaactgatccgcgccgatcatatggtgcgtctcatccgttagcggcagcaccaggcagacaaaatcggcttcttccagcagggcatccagttcacagtaacgcgcgccaaagcgctcttccgcttccgtatgatgacggcgggcgttatagaggatcggcatgccgaaaccaaagtgcgcgcgctgcgccagtgccagaccgatgcggcccatgccgacgatgcccagcgttttatggtgcacgtcgatgccaaaccagtccggcccgatgttttttgtccattcgcctgcttttacgcgctccgccacttccaccacccgacgggctgtgctcagcaccagcgccatcatggtatcggccacggtttcggtcagcacggtaggcgtatgcatcagcaggatcttacgatcgtttaacgcatccacatcgaagttgtcatagcctaccgagatggtcgacgtggcgcgtagcttcggcattttctccagcagcgcggcgtcgactttctcgcttgaacccagcaaaccttccgcactggcaaatgcctctgcatgttgttgcaccgtctccggatgcagattcggcaccctggtgacggtgaaatggtcttccagacgtttttgtagatcatcaggcatggctttgtacagaataatggacggcttcatgcggttctcccaaatcagtaatagcgggtcgtcaggcgcatcatgcgtggcgcgcgcccgccggaatctgttgattattagcaggcttaacaatcagagtaagccataccgagacaaaaagcgccacccccataaagatgtacgatgccgccgggctgcctgtcgatccgttgagataacccacgaaccaggagccaaagaaagagccaagcgcgcccatactgttgatcagcgccatcgcgccacccgcgacattacgcggcaacatttccgggataatggcgaagaaagggccgtaaggcgcatacatcgccgccccggcaatcaccagcagcgtataggaaacccagaaatggttcgcccctacggcccaggagccgataaaggcaaaggcggcgatcaacagcagcggccagacaaagagtttacggttttgcattttgtccgacgcccatgaggcgaggatcatcgcaatggtcgccgccagataaggcaccgaggagagccagccgaccgccaccataccgagattttcaccgccgctgtgaataatggacggcagccacagcacaaagccgtacacgccgatactccaggcaaaatactgcatacacagcaggatcacgttgcgcgaacggaaggcttcgccgtaattacgcaccgctttaataccctgttgttcctgctccagctgcgcctgcaacgcggctttttcctctgccgccagccatgacacctgcgacggtttatccctgaccagcacccaccagcagaatgcccagagcactgccggtacgccttcaataatgaacatttcgcgccagccgaaagactggatcaggtagccggacaccaccgacatccacaacaccgtgaccgggttacccagaataaggaaggtattggcgcgcgagcgttctgatttagtaaaccagttgctgatataaatcagcatcgcgggcatcaccgccgcttccaccacgccaagaataaagcggatcgccgccagcgccggaatattatttaccacgccggtgagcgaggcgcaggcgccccataagatcagacaaataaagatcaatttccgcacgctgcggcgttcagcgtacattgcgccggggatctgaaagaagaagtagccgaggaaaaacagtgcgcccagcagcgatgagacgcctttagtgatgccaagatcgtcattgatgcctgccgcggaagcgaagctaaagttggcgcgatccagataagccaggctgtatgtgataaacacaatcggcataatgtacagccagcgttttgttgcattagtcggacttttcatagggttgcctctggcattgtagggtactgaggttcaaatatgataaagaggggcgctttacccctcgttaagctgtgcccgcgttggcaatccttcgctgtctccctgcacctgaatggccagtgagccgattttatttccccgatcgatagcctgtttaagtgagcggccttccagcagcgcgctgaccaggccgaccgcaaagccatcgcctgcgcccacggtatccaccacgttatccactttaatcgccgccaccgccccctgctcgccgtcggcggttttgaaccacgcgccgtcagagccggctttgatcaccacgattttcacaccacgtgacagatagaaatcggcgatgccttccgggtgttgctggccggtaaggatgacgccctctttcagccccggcagcacccagtcggcctggaacgcgaggtgattgagtttctcgaccatctcggcttcgctcttccacagcactggccgcagattaggatcgaaagagatcgttttgccgcgcgctttcatcacgcccgccgcatgatccagcagggcatacgcatcagacgacaaggccgccgccacgccgctcagatgcagatggcgcgcgctggtgaacatgccttcgtcgaaatctgccagcgacaaatggctcgccgccgagttcttgcggaaatactccacgatgggatcggttccattttcaaccttagatttcagctgaaaacccgttgcgtaccgcccgtcaatagtgacgccgccggtgccgatgccctctttttccagcgaattcagcacgaactgcccgaagctgtcatcgccgacgcggctgacccaggcgactttcatgccgaggcgcgcaaggccggtggcgacgttcagctcagcgcccgcgatgcgtttaaaaaagtgctccgcccgggccaggtcgccggtttcggtggcgacaaacatggccatggcttcgccgatggtgatgacatccagcgcatgatgcatggcgttactcctcacgtaataaattgacatagcggcgcgtgacggcggtcagatcgcggccttccagtggaaactcaatgccgcgcggcacgtcggcgggaagctgattcagcagttccgcccagcggccgtcggcctgatccggcgcaatggcgcgataatggtaatgatgcgcgatagcggctttcacatggatatagctgacggcgggggccagctggcgggccgcttcttccggcgattcgccgacccacaaccagttcgccatatcgaaggtcagggtgaccggcagatccagcacccggcaggcggctttaaaacgctgcatcggcgcaagctggccgcaatcggtctgatcgttttccaccaccagcgtcatgccgctgtccgccagccagccgcgcagcaactccagcgcggatttgtgctggaaatgcccgagagagactttcagccacagggcgtttaaggtgcgcgcttcctgaagcagagcgggcagttcggggttcagcgtgccgtcaaacagacacagcggctccggcgcggagtagcaggccagcaggttatgggattcgatgtcggcggccagggcaggcagggcgttcagttcatcaggcgtgaacaattcgcggcggatctccacgccgtctgcgcctgccgccgcaataaacggcagcacggcagcctgaccgcccagcgactgaatacggtcgtggccgtaagcggcagtgacgacgataatttttcttttcatttcccggctcccgaacaaatgcctgttggcttctgtttaagctagatggaaccggttccaaatgaaaggtcaggatcgccaaagcatgatcgtcatcacgaaggggaatcagcgggcggtggagccgcgaacgataagttcgccggagaagacctgttcatgcacggtattgtcggtgccgtcgatgcggcgcaccacctgctcgacggcggcgtagccaatctgccaggtaggctgtttgagggtggtgatgccgacgcccgcaagctctgcccactccagttcgtcaaaaccgagcagaccgatgtcgctgccccagtgtaggccaatgcgcttcagcgagcgggcaacctggagcgttaatgcgccgttggcagagatcaccgctttgcgcatgccccggtgacgggtatgaaactggcgcagcctgttgtcgatttgcccggcttcatgcagcacaacttcagcatcttccgcaatgacgccgggatagcgggcgagggtggcatgaaaggcgttcagacgctcacggcgggtattcaccgtgccgagaggttcactaagaaacagcagcgcttcaaatccctgctccaccagatgttcggtggcggtggtggcggcctggatgttatccagcccgaccacatcgcaggcgaagtccggaattttacggtcgataagcaccatgggcagcgacgattgttgcaggcggttcagcccctcttcgcgcattcccacggcattcaccacgatcccctccacctgataactgcgcagcaaatccagatagtgcagctcctgatcgagggcgttattggtattacacaccagcggcgtaaagcctttctcacggcaggcagcttcgataccgctcagcacgttcacggaatagggattggtaatatcggcgatgatgaggccaatcagccgcgtacggccgcgtttcaggccgcgggccatcaggctgggacggtaattaagttcggcaatggcgttttcgatgcgggccagcagagcctctgaaagcagatgcttttcaccgttcagataacgtgaaatgctggttttacccgtttttgccgctttcgcgacgtcgctgattgtcgggcgcgctgcctttgcgttcatgtccgtctcctggggtaactttgcggagattaacatattttacgcggaatacccctcgcctgcaggcgagggggtaaacagagggattactgcaacggactcagggtaatttccacgcgacggttctgcgctttgccttcttccgtgctgttgctggcaatcgggttcgccgggcctgcgccggtagtacgcagacggttcgcttccacgccctgggtgatcagcgcgctggcaaccgcatcggcacgctgctgcgacagacgcatgttcagatccttgccgccggtgctgtcggtgtaacccaccacgttaaccgcggtttttgggtactctttcagtaccatcgccacgccggtcagggtattggcacctgccggtttcagggttgcgctgctgctgtcgaaggtcacgttgttcggcatgttcagcacgatgttatcgccatttcgcgtcacgctaacgcccgttccctgcattttgtcccgcagtttcgcttcctgcacgtccatgtaatagcccgcgccgccgccgagggctgcaccggccgccgcgccaatcagcgcccctttgccgcggtcttttttcgaggaggagagtacgccgacgcccgcgccgaccagcgatccaatgcctgcgccaatgcctgatttaccggcttcgcgctcaccggtgtaagggttggtggtgcagcctgaaacagccagtgcgccgcaaaccgcagccacaatgagaaggacatttttcttcatcgaatttccttaataatttttaattctatgcacagcgataatcgcggttgattatgacctgatgatcgttagaaacttccggaaagattctgaattttgtaaataacattgagcggcgcatgagcgaccgacacacctgcatcagacatcagggagcatacgttttggcacactcatccacaaaaaccattctcacggcagcccactgggggccgatgctggtagaaaccgacggcgaaaacgtcctgtcatcgcgcggtgccctgccgaccgcccatcccaattcgttacaaaccgccgtgcgcgatcaggtgcacagcaacagccgcgtgcgtttcccgatggtgcgcaaaggcttcctgacgtcaccggaaaaaccgaccggcgtgcgcggtcaggatgagtttgtccgcgtcagctgggatgaagccctggatctgatccatgcccagcacgtccgtattcgtgaaagctatggcccgtcgtcgatattcgccggatcttacggctggcgctccaacggcgtgctgcacaaagcggcgacgctgttgcagcgttatatgagcctggcggggggctataccggccatcttggggattattccaccggcgcggcgcaggcgatcatgccctacgtggtgggcggcaatgaggtttatcagcagcagaccagctggccgctggtgctggagcattctgatgtggtggtgttgtggagcgccaacccgcttaacactttaaaaattgcctggaacgcctcggacgaacaggggatcccttatttcgatcagctgcgccagagcggcaagcgggtgatctgcatcgatccgatgcgatcggaaaccgtcgacttcctcggcgacagtgccgaatggctggcaccgcatatgggcaccgatgtggcgttgatgctcggcatcgcccacacgctggtggaaaacggctggcaggatgatgaattccttgcccgctgcaccaccggttacgacatcttccgcgattatttaaccggcgccagcgatggcgtggcgaaaaccgcagaatgggccgcggaaatttgcggtattgatgcgcctaaaatccgcgaactggcggaagtgttccataaaaataccactatgctgatgtccggctggggcatgcagcgccagcaatatggcgagcagaaacactggatgctggtgacgcttgccgccatgctggggcagatcggtctgccgggcggcggctttggtttgtcctatcactttgccaacggcggcaatccgacgcgccgcgcggcggtgctcggctccatgcagggcagcgttcagggcggcgtggacgcggtggataaaatcccggtggcgcgcattgtggaagcgctggaaaaccccggcggcgcgtaccagcacaacggcatggatcgtcatttcccggatattaaatttgtctggtgggcgggcggcgcaaactttactcatcatcaggacaccaaccggctgatccgcgcctggcaaaaaccggagctggtggtgatctctgaatgctactggacggcggcggccaagcatgccgacattgtgctgccagccaccacctcttttgaacgtaacgatctgaccatgaccggcgattacagcaatcagcatctggtgccgatgaagcaggtggtcgccccacgtgatgaagcgcgggatgattttgaggtgtttgccgatctcagcgagcgctgggagcagggcgggcgggcgcggtttaccgaaggcaaaagcgatctgcaatggctggaaaccttctatgacatcgccagcgcgcgcggcgccagtcagggcgtgacgttaccgccgttcgcagaattctggcaggccaatcagcttattgagatgccggaaagcgaggagaacgcgaagtttgtgcgttttgcggccttccgtgccgatccggcggcgaacccgctgaaaaccgacagcggcaaaattgaaatctattcgcagcgtatcgcgtcatttaactatgccgactgtccggggcacgcgacctggctggcgcctgacgaatggcacggcaatgcggagccgcagcagttgcaggtgctgtccgcgcatccggcgcaccgtctgcacagccagttaagctattccgcgctgcgcgagcagtacgcggtggcggggcgtgaacccatcacgctgcatccgcaggatgcgcaggcgcggggtattcgtgatggcgacctggtgcgcgtgtggaacggtcgtgggcaggtgctggcgggcgcagtggtgaccgaggggatccgtccgggggtgatctgcattcatgagggcggctggccggatctggatccggcggccggggggatctgcaaaaacggtgcggttaacgtgctgaccaaagatctccccagctcgcggctgggcaacggctgcgccgggaacacggcgctggcatgggtggaaaaatacaccggccctgagctcaggctgacggcgtttgagccgcctgccagcgcatgatccacgtcgggtggtgagtctcctcctgccaggcgctgtcttcgatacgaaagcccagcgcatggtagaaattcactgcccgctcattcttctgatacacctcaagactgagatcggcatagcgctgtttgacatgctcaagcagcgcgcgtccgatccccttgccgatcgcgtcaggacgcacaaagagcgcaccgacaaagcggctgtccatcacgctgacgaatccctcaaggcgaccctgttcttcccacacccaggttctggcggcgggtaaataggcatcgcgcaccaggcttttactctcctgccagtaacgcgcgtcgataaaaggatgggcaaaggtggtgctttccagccacagcgccagcagcgctgacgggtcattatcataccattcgtggatcatcgctgcctccgggatgacaaaagcactgggtaacatggtcattcaccagaccgcaggcctgcataaaggagtaacagatggtggtgccgacaaacttgaagccgcgttttttcagcgcttttgacagggcatccgattccggtgtcgacgtggggatctccgcaagggtggcggcctgggtcatcctgacctgatgatcaacaaaagaccagacaaaatctgcaaagtcttccccctgttgctgcatcgccagataggccctggcgttgccaataatcgcctgaatttttccccgatggcggataataccggcgtcctgcaacagcctttctacgtcgtcaccctgcatcgccgccacgcgtacaggatcgaagttataaaaacagcggcgataattttcccgtttcttcagcactgtgatccaggataaacccgcctgctggccttcgagacagatcatctcaaacagcttctggttactggactgcgccacgccccactctttgtcgtggtagtcgatatacagcggatcctgactgacccaaccacatcgttgcatgtctttctcctttccattgttgcggtagatcccaaaagaaaattatcccgctggcttgacgtgtctcttaaagagacaatagttaatacagggttttatccgcacaaaatgataacgatactgccggttttggctcttttctggagtcgcattgatgaagataaaaaataacagtggctgccgcctggcgctcgtgcctgtgtgcctgtttttttgtcagacggcgcaggcgtggcaacaagaatatatcgttagcgacccgcaaagtaatatggcggatcgctatacatgggacagcgatcaccaaccgcgttatgacgatattctcgaagggcggatccgctcgacgcaaaatacgcctggcctgtcctggaatttgccggatgatacgccgctggacgccaccagcaccatgagcctcggctggaatattccgctggtgaataatgtcaccaccggcccggtggccgtctggcattacgacagctctgcctcatcaatgcataatgaatttggcgatggcccggcaaacctgcaattcaccgatccgctgtggcatgccagcgtcagctcagtgggctggcgcgtggacagtcgtcacggggatctccgcccgtgggcgcaaatcagctacaaccagcagtttggcgaaaatatctggaaaacccagtccggcctcaatcgtttatcggcctccagccaggacggtaactggatggacgtgaccctcggcgcggatatgctgctcaatccccattttgcagcctatgcttcattgtcgcagtctgaaaatacggacatcggtcaaaactatctttacagcatgggcgtcagcgcgcgcttttaattagcatttaaaacaaattaattacattttttatacaacaatcatcagcttcgcagagatagtgtgtactaacttacactgtattttttgctgatgagacttttcccgctgtcattcattcccgttacaaggcatttcattccgtcctcactgcatttcatgccgttttcgatccggcatcaacggcgcttcgttatggttaacggcagagaatttcccttttgcttacgcaggaagactgccatgaatacatcctcattgaatcggacccgctggctgacgctggtcggtaccatcattacgcaatttgcccttggatcggtttatacctggagtctgtttaacagcgcgctggcggaaaaactggatgagccagtaagccaggtggcgttctccttcggcctgctcagcctcgggctggcgctctcttcctcggtagccgggaaattacaggaacgtttcggcgttaaacgtgtgactatcgcatccggtattctgctgggcctcggctttttcctgacggcgcacgccaacagcctgctgatgctgtggctgagcgcgggcgtgctggtcggccttgccgatggcgcgggctacctgctgacgctctccaactgcgtgaagttcttcccggagcgtaaggggctgatttccgctttctccatcggttcttatggcctgggcagcctcggctttaaatttatcgacagccatctgctggctaccgtcggcctggaaaagacctttatgatctggggcgcgatggtgctggtgatgatcgtttccggcgcgatgctgatgaaagacgcgccgcagcagaaagcgaccatggtcaatggcgtggtggagaatgatttcaccctggcgcagtcgatgcgtaaaccgcaatactggatgctggccgtgatgttcctcactgcctgtatgagcggtctgtatgttatcggcgtggcgaaagatatcgctcagggcatggtgcatctggatgtggcgaccgccgccaatgcggtgactgtgatttccattgctaacctgacaggccgtctggtgctcggtatcctctccgataaaatgtcccgcatccgcgtgattacgctcggtcaggtggtgtcgctgattggtatggcgggactgctgttcgccccgcttaacgaagtgagcttcttcgcggctatcgcctgtgtggcctttaacttcggcggtaccatcacggtcttcccgtcgctggtcagcgaattttttggcctgaacaatctggcgaaaaactacggcgtcatttatctgggctttggtattggcagcatctgcggctcgattatcgcctcgctgtttggcggcttctatgtgaccttctgcgtcatcttcgccctgctgatcctctccctggcgctttccaccaccattcgtcagccgcagcgtgaatacttcaccaactcacagccgctgactcaccattaagtgacctgcgccacgctctgcgtggcgcttcgcaatcttcaaccttctcccttcctgaatcaggggtaatacggtaagctctgccgtattacctattatttttgtaaatgtttagtcagatcacattcccggtgacacttttttccacccctgtggtctactaccccgcgcttcacgaagttatcgaatcaacttcttatgcgtttgataagcctatatgcagatatatcgtctgcgcacgggtgctctctattcccttctcccagggtgctttgaatgaaatatatcaaaacgatgacgcaacaacggctgagttttttgctggcgttgtacatcggtctgtttatgaacgccgctgtttttattcgtcgctttgatggatatgcgcaagaatttaccatctggaaaggcctcgctgcgattgttgaagtggcgggtacggtattagtcacgttctttttacttcgacttctctctctgtttggacggcgtgcctggcgcgtgctgtcgacgctggtggtgctgttttccgcaggcgccagctattacatgactttcctgaacgtggtcatcggctacggcattgttgcctcggtgatgacgacggacattgacctgtcgaaagaagtggtgggcatgcagtttgtgatctggctggtatgcgtgagcacgctgccgctgatctttatctggagcaacagcagccgcctcacgctgctgcgccagctgcgtacgccgggcctgcgcatccgtagcgcggccatcgtcgtgctggccggtttgatggtctgggggccgatccgtctgctggaagtgcagcaaaagagcgtagagcgcgcgaccggcgttgatatgccaagctatggcggcgtggtggctaactcttatctgccgtctaactggctgtccgcgttagggctgtacgcctgggcgcaggtggatgagtcttctgataacaaatcgctgatcaacccggcgaccaaatacacttacgttgcgccgaaagatctcgatgacacttatgtggtctttatcatcggtgaaacgacccgctgggatcatatgggcctgctcggctatgagcgcaacaccacgccgaagctggcggcggagaaaaatcttgtcgccttccggggttactcctgcgataccgccactaagctgtccctgcgctgcatgtttgtgcgcgagggcggggcggatgaaaacccacagcgtacgctgaaagagcagaacgtttttgcggtgctgaaacagctcggcttctccagcgacctgtacgccatgcagagcgaaatgtggttttacagcaataccatggcggataacatctcctaccgtgagcagattggcgctgagccgcgtaaccgcggtaagaacgtcgatgacgcgttgttgctggatgaaatgaaagcgtcgctgaaaaacagccctgacggcaagcatttgatgatcttccacacgaaaggctcgcactttaactacacccagcgttatccgcgcagctttgcccagtggacgccggagtgtcagagcgtggacgacaagtgcaccaaagcggagatgattaattcctttgataactccgtgacctatgtcgattactttattgatagcgtcatcgatcagctgcgcgataagaaagcgattgtgttctatgccgccgaccatggcgagtcgatcaacgagaaagaacatctgcacgggacgccgcgtaaaatggccccgcctgagcagttccgcgtgccgatgatggtgtggatgtctgataagtatctggagaatccggagaaagccaaaatgttcgcgcacctcaagcagcaggccgatatgaaagtgccgcgccgccatgttgagctgtatgacaccatcatgggctgcctgggatatacctcgccaaatggtggtatcaacgagaacaataactggtgccacatcccggatacaaaggcatcggcgggtaagtaaactgactggcgagtttatcgccagtcgaaaggcttttttacgttaagggattgacggttgcggtgcccggcagtaagatgcgccccgcattcggtgattggcgcagcctggtagcgcacttcgttcgggacgaaggggtcggaggttcgaatcctctatcaccgaccaaatttaaaaagcccaaccttctggttgggctttttgctatctgtggttcgggaggatgagaagctccgggggaggaggttcgcgccgagcgaagcgagacagcgttgcgcagcaacgacccgaagggcgagccacagcgtggcgagtaatcctctatcaccgaccaaatttaaaaacccgtcgtggaaacacgacgggttttttgcattttccgccgctcctgtaggccgggtaagcggagcgccacccggcggaaataacacttttaaatcacgcgtcgatatcgctcataattctctgcatttgccagatattccatcgtatttttttatatatgtttgaatcttttttcgcgttgcttatggataagctcagcattttcacctgtgcgttttaacgttcgcggtattaatcgctcagatattcatcattccgtcagaaatttttcataaactgggtaaatgttaatcactgatgtgagacttaaaagcagcggtttattctggcatccgaccagtagcacaattttccctgctgaaaacaggggcgtgcactttttttaatctttgtttgccaattctcaccgtcgttgtaaatcccggttacctgtattgacgttttgacattctgttgacagattgtagggcatgaggggcatttcacggagaatctgcactgcaactcagtcaaccttgtgaaaggattccccatctctcatatagcctccgggcacaaccgaccagaccggtaaaaaataaataaaggcctgtcggatataccctttgcaacgggtaaacaacacatatcacattggagcagaataatgagtatttccttgaagaagtcagggatgctgaagcttggtcttagcctggtggccatgaccgtcgcagcaagcgtacaggccaagaccctggtttattgttcagaaggctcgccggaaggctttaacccacagctctttacctctggtaccacttacgacgcaagctcagtgccaatctacaaccgtctggttgaattcaaaattggtaccaccgaagtgatcccgggcctcgctgaaaagtgggaagtcagcgaagacggtaaagtttataccttccacctgcgtagcggtgtgaagtggcaggacaacaaagatttcaaaccgacgcgtgaattcaacgccgacgacgtggtgttctcttttgatcgccagaaaaacgctgaaaacccgtaccataaagtgtccggcggcagctatgaatacttcgaaggtatgggcctgccagacctgattagcgaagtgaaaaaagtggacgacaaaaccgtacagttcgtactggcgcgtccggaagccccgttcctggctgaccttgccatggacttcgcttctatcctgtctaaagagtacgctgacaacatgctgaaagccggtacgccggagaaaattgacctgaacccaatcggtaccggtccgttccagctgcagcagtaccagaaagactcccgcattctgtacaaagccttcgaaggcttctggggtactaaaccgcagatcgaccgtctggtgttctctatcaccccggacgcgtctgtacgttatgcaaaactgcagaaaaatgagtgtcaggttatgccgttcccgaacccggctgacattgcacgcatgaagaaagacaccaaaatcaacctgatggagcaggccggtctgaacgtgggctacctctctttcaacaccgagaaaaagccgtttgatgacgtgaaagttcgccaggcgctgacctatgcagtgaacaaagaagcgatcatcaaagccgtttatcagggcgccggtactgccgcgaaaaacctgatcccgccaaccatgtggggttataacgacgacgttaaggattacacctacgacgttgagaaagcgaaagcgctgctgaaagaagccggtcaggataaaggtttcaccgttgaactgtgggcgatgccggtacagcgtccttacaacccgaacgcacgccgtatggctgagatgatccagtctgactgggcgaaaatcggcgttcaggccaaaatcgtgacctacgagtggggcgagtacctgaagcgtgcgaaggcgggcgaacaccaggcggtgatgatgggctggaccggggacaatggggatccggacaacttcttcgccaccctgttcagctgcgacgcggcgaaacaaggttccaactactctcgctggtgctacaagccgtttgaagatctgatccagccggcacgtgcgactgacgatcacaacaaacgtattgaactgtacaaacaggctcaggtagtgatgcacgaccaggctccggcgctgatcatcgcgcactccaccgtgtacgagccagtgcgtaaagaagtgaaaggctatgtggttgatccactgggcaaacaccacttcgaaaacgtgtcagttgaataattaaaacccagggggtgcgcacgcaccccatgcccggcggcgctacgcttgaccaggcctacacccgtaggccggataagcgcagcgccatccggcataatgctttacctgagcggtatccgcgcaggataagatttgtgagcaatacagacacgtctttgacgctgtcactacagagaatccgggttatgttgcagttcatcctccgacgtctggggcttgtcatccctacgtttatcggtatcacccttctcacctttgcctttgtccatatgatcccgggcgacccggtcatgatcatggcgggtgagcgtggtatctcccctgagcgtcacgcgcagttgctggccgagcttggcctgaacaagccgctgtggcagcagtacgtcaactatgtatggggcgtgttgcatggagatttaggggtttcgcttaagagccgtctcccggtgtgggacgagtttgtgccgcgttttaaagcgacgctggaactcggtgtctgcgccatgatatttgctgttgccgtgggtattccggtgggcgttctcgccgccgttaaacgcggttccatctttgaccacaccgccgtcagcgtcgcgctggccggttactccatgccaatcttctggtggggcatgatgctgatcatgctggtgtcggtgcaactcaacctgacgccggtatccgggcgcgtcagtgacatggttttccttgatgatactaacccgctgaccggctttatgctgatcgacaccgccatctggggtgaagagggcaacttcattgatgcgctggcgcatatgatcctgcctgcggtggtgctcggcactattccgctggcggtgatcgtgcgtatgacccgctcatcaatgctggaagtgctgggtgaagactacatccgtaccgcccgcgcgaaaggcctgacccggatgcgcgtgatcgtggtgcatgccctgcgtaatgcgatgctgccggtggtcacggtgatcggcttacaggtgggcaccatgctggcgggcgctatcctgacggagacgattttctcctggccgggactgggacgctggttgatcgacgcgctgcaacgccgcgattacccggtggtgcagggcggcgtgctgctggtggcgacgatgattatcctcgtcaacctgctggtcgatctgctttacggcgtggtgaacccgcgtattcgtcataagaagtaaggggccatcatgtcacaagtaactgaaaataaagcggtgtccgcaccggtgccgatgaccccgatgcaggagttctggcactattttaaacgcaacaaaggggcggtagtcggcctggtgtatatcatcgtggtgctgattattgccatcttcgccaactggatcgcgccttataacccggccgaccagttccgtgactcgctgctcgcgccgccggtctggcaggaaggcggtagctgggcgcatctgctcggcaccgatgacgtaggccgcgacgtgatgtcgcgtctgatgtacggcgcgcgcctgtcgctgctggtcggctgcctggtggtggtgctgtcgctggtgtccgggattatcctcgggcttatcgccgggtatttcggcggcctggtggataacatcattatgcgcgtggtggacatcatgctggcgctgccgagcctgctgctcgcgctggtgctggtggcggtctttggcccgtccatcgtcaacgcctcgctggcgctcaccttcgtggcgctgccccattacgtgcgcttaacccgcgccgcggtaatggtggaagtgaaccgcgattacgtcaccgcctcccgcgtggccggtgccggtgcgatgcgccagatgttcgtgaatatcttccctaactgcctagcgccgctgatcgttcaggcgtcgctcggcttctctaacgccattctcgatatggccgcccttggcttccttggcatgggtgcgcaaccgccaacaccggagtggggcaccatgctgtctgacgtgttgcagttcgcacaaagcgcctggtgggtcgtgaccttcccgggtctggcgatcctgctgacggtgctggcatttaacctgatgggtgacggcttgcgtgatgcgctcgaccccaaactcaagcagtaaagggctacgaaatggcgttattaaatatagataaattatcggtgcacttcggcgacgaagggacaccgttccgtgccgtagaccgcgtaagctacagcgttgagcagggtgaagtggttggcatcgttggtgaatccggttccggtaaatccgtcagctcgctggcgatcatgggactgattgatttcccgggccgcgtaatggccgacaagctggaattcaacggccaggacttaaagcgcatctctgaaaaagagcgccgcagtctggtgggcgcggaagtggcgatgattttccaggatccgatgaccagccttaacccgtgctacacggtgggtttccagattatggaagccattaaggtgcatcagggcggcaacaagaaaacccgccgccagcgtgccatcgacctgttaaaccaggtgggtattcccgatccggcctcgcggctggacgtttaccctcaccagctctccggcgggatgagccagcgcgtgatgattgcgatggccatcgcctgtcgtccgaagctgctgatcgccgatgaaccgaccaccgcgctggatgtgactatccaggcgcagatcatcgaacttttgctggagcttcagcaaagggagaacatggcgctgatcctcatcacccacgatctggcgctggtggcagaagcggcccataaaattattgtgatgtatgccggtcaggtggtggaaaccggcaaggccacggatattttccgcgcgccgcgtcatccgtacacccaggcgttgctgcgcgcgctgcctgagtttgcgcaggacaaagcgcgtctggcctcgctgccgggcgtggtgccgggtaaatatgaccgtccgaacggctgtctgctgaacccgcgctgcccctatgccaccgatcgctgccgcgtggacgagcctgcgctgaatacgctgagcgatggccgtcagtctaaatgtcactacccactcgatgatgccgggaggccgaattatgagtacgcatgaggccaccctgcaacagccactgttgcaggctatcgacctgaaaaaacactacccggtgaagaaagggctgtttgccccggaacgcctggtgaaagcgctggacggcgtctctttttcgctggagcgcggtaaaacgctggcggtggtgggcgaatccggctgtggaaaatccacgctcggtcgtctgctgaccatgatcgaagtgccgaccggcggcgagctttactatcaggggcaggatctgctcaagcctgatatgagcgccgaaaagctgcgtcgccagaagatccagatcgtcttccagaacccgtacggttccctgaacccacgtaaaaaagtgggccagatcctggaagagccgctgcaaatcaacaccacgctgagcaaagaacagcgccgtgaaaaagcgctggcgatgatggcgaaagtcggcctgaaaaccgaacactacgatcgctacccgcatatgttttccggcggccagcgtcagcgtatcgccattgcccgcgggctgatgctcgatccggacgtggtgatcgccgatgaaccggtgtcggcgctcgacgtgtccgtgcgcgcgcaggtgctgaacctgatgatggatttgcagcaggatctggggctgtcttacgtgtttatctctcacgatctgtccgtggtggaacacatcgccgatgaagtgatggtgatgtacctcggtcgctgcgtggagaaaggcaccaaagagcagattttctccaacccgcgtcatccgtatacccaggcgctgctctctgccacgccgcgcctgaacccggacgaccgccgcgaacgtatcaagctgaccggcgagctgccaagcccgctgaatccgccgccgggctgtgcctttaacgcccgttgtgttcgtcgcttcggtccctgcacccagttgcagccgcagctgaaagagtacggcggccagctggttgcctgcttcgcggtggaccaggacgagaatggcgaaaagccgattgttcacggttgattaaccctgcccggcggcccatgcctgccgggaccggggcagcaccgattttccaggccgggtcaggcgtaaccgccgcccggcaatttaagcacccgtactggctgcttaaaatcctcttttgaaccacctgactaatgcaaaagactgactatttaggataagataatactttgcactaataatgtggttattcatgaaagtataagactttacttattccgacatcaaaaaaagatagcatcctggcgggcaaaatttatatatttgctgccgttaagtggtgggttaaaaacgccctataaaatcacccactaaattagcttaacgcttcaccctgttattatacccgcacgttattattaattacgccaccttatcagtgaaatgcttttaagaagcattaaaggttgattgtaatattttttatttgtaaatcatgagtataactatgaaccattatgatgatttgcagaggtttaaggataagactcgcactcagcatctcgattttaaggatttgtcttcccagaatcagggtagcgagcaggggaactgggcgattattaatcagctgtcgcccgctactgaagaatcgacgctggcgatgggtggacacgtttctgctgctattccccaggcggttaatcctgaaatcttcgcagtaaacccaaccacgccgcctgctgacgctatgactcacgcgtcacctgagtcagcgcccgtgacgacctcccttttccaggacgtggcctcacagctgtctgtcccgccgcaacccgaggccgcgcctgcgccagccatcacgcctgcggctccgccgtctgcgcccgagcctgtcgccatcgcgcctgcgccgctgcggtcagttacccctgcgcctgccgccgcaccggtgaattttgcgcagctgtttgcgccaaaggtcacagagacgaaaccggccgcagaaaagaaccagcccctgaaatcgctgttagaaaggatcgcttcatgccgttgatctgtgtctgttcgcccaagggcggtgtcggaaaaacaaccatgaccgcgaaccttgcttacgcgctggcacgggcgggaagcaaagtgctggcgctggattttgacgtgcagaacgcgctgcgcctgcattttggcgtgccccttgccgatggccgcggttttgttgcccgcgcggcagagttgcctgactggagccagtttgtattatcggcaggcagcaacatgttcgtgctgccttacggtgacgccaccgaagcccagcgcgaagcctttgaagatcgcctgacgcacgacgagcattttctgacccgcgggctgaacaccctgcttaattatccgggtctgatcattatcgccgatttcccgcccggcccctcaccggcattaaaagcgctgtcacgccttgcggatctgcatctggtgaccctgctggcggacacggcgtctctctcgttattaccgcaggtggaaaaccaccgtcttaccggcgatgtgctgaaccgcaaagcggggcattacattctgctgaaccagagcgacaaccgtcggcaaatcagccgcgacgtgacggcctttatggagcagcggctgggtgagcgcctgattggtatcgtgcatcgcgatgagagcgtcggggaagcgaacgcctcgcaacagtccgtcttcgatttcagcccggcctccgccgcggcctttgatattgagctgattgccaaaaagatcgccaatatccttgatgtgaaagttggcgatggcaccgttcataaccttccgaagatgtctggtttctaattctccacagagcgatttatgaaaaagttcctgttttatttgctggtgctggcactggcgcctgctgccgtgctggtcgtcattacgcccatggacagccagaaacagtatatttttggattgatcagcatcgggattttattcctgatgggcttttctaaaaaacgtagcatttcggtgatcatggtggtgatgtcgatattaatgtcgacccgctatatgtatttccgcgtcacgcaaaccctccattttaattccgagattgagacgatcctcggcatgggattatttctggcggaagtctatatctggatcatgctgctgctgaactatttgcagaccatctggccgctgaagcgcgaaattgtgcccttgccggaggatatgaaccagtggccgaccgttgacgtttatatcccgacctataacgaatccctcgacgtggtgcgcgacaccgtgctggcggcgcagtgcattgattatccgaaagataaaatgaaaatttatattctggatgatggcaagcgccgtgaattcgcggtctttgccgccgatgtcggcgtcggctatatcacgcgtaatgagcactcgcacgcgaaagcgggcaacctgaaccacgccatgaaactgacccacggcgagctgatcaccgtcttcgactgcgaccacgtggcaacgcgtattttcctgcaggcgacggtgggcggttttctcacggatccgaaactggcgctggtacagacgccgcactatttctattcgccggatcccttcgagcgtaacctttccgtcggccgcaatattcctaacgaaggccagctgttctacggcccgatccagcagggtaacgataactggaacgccacctttttctgcggctcctgtgcggtgatccgccgtagcgcgctggaagagattggcggcttcgctgtggaaaccgtcaccgaggatgcgcataccgcgctgaaaatgcagcgtctgggctggaaatccgcttttctggatattccactggcggcggggctggcgaccgagcgtctggtgctgcacgttattcagcgcacccgctgggcgcgtggcatgacgcagatcttccgtgtcgataacccgctgttcggccgcggcctgaccattcagcaacgtctgtgttatctcagcgcgatgatgtattaccagttcgccctgccgcgcattgcgtttctgaccgcgccgctggcgtatctgctgtttaacctcaacatcatttactcctccgcaagcctggtttttgcctatgcgctgccgcacctgttcctcgcgatttatctcaactcgcggatgaacggtcgtcaccgctacagcttctggggcgaaatttatgacctggtgctggccttccatctggtactgccgacggcggtcaccatgctgtttccgaaacgcggcaagtttaacgttaccgataaaggcgcgctgctgaacgtcggctactttgatttccgggtcgtgcgcccgcatctggtggtggcgatcctgctcgccattgcggtgatctggggcctggtgcgcgctttcgcccatgaccattttggcgtcgatcctaaggttatcgctctcaacgtgttctggggactctacagcctgatcttcctgctggcggctattgccgtggcgcgggaaacccgtcagacgcggaaaaccatccgtatcgatgtgaagatcccggtattgatccattacgccagcggtatctcgtcgcgcagcgaaaccctcgatctgtcgatgggcggctgccgtatcgtcgcgccggatgaacgccatttaaatgatgaaatcgaagaagtggagctgttattacagtccggtgccatcagcattccggtgaccaccatgggcgtggacggtgaatttattcgcctgaagtttgcggaagatattccgctctcacgtcgccgtgaactggtacgggtggtgctgtcccgcgctgatgcgtggatcaacccgccgaagccgcaggacaacccgttccgctcgatgctcaccatcatgcgctgtgtgttcgacctgttctggctgacgtggaaaacgcgccgtgaaaaccggcgtcagcgtgctctcctcaacgcctcaccggaggacggcagcctatgaaacgtttaacccggctggcgattatcgtcagcgcactctttatcacgccgctttacgcggaagaaacgctgccggacactctgctgccgtcggatttccccgcgcctgtggtggatactgccccggctgcgcccccggcctttgtgccgacggtggtgacttccctttccgtggcgcaaatgggccagccgcagggcatcgtactgagcggcggccagttgcagggcggggtgaacttcaccctgccggtcggtcaggttatgactaacgcccagctgtcgctgaacctgaaagtctcacccgccatggcgacccgcaacgccaccatgcagctgatgcttaacggccagccgctgggcacggtgccgctgggcgcggcggaatccgatgtctcgcgctttcagctggatgttccggcggcgctgatggtctccagcaataccatcagtttcaaaattaatgatggcgacgccatgatgtgccagcgggatctgacggataaataccgcgtcaccatcctgcctgactcggcgtttaacctcgaagggcagccgctggatattggatcggatctgagccacttcccgcgtccattcttcgacaacatgcagatgacgcccgccactatcacttttgcgttcccggcgaagctgacggcagataccatcagcgcggcggcgctggtgtcatcgtggatgggtattcaggcggactatcgcggcgtctcttttgccgcgcaacgcgatcgcctgccggaacagaacggcattctgatagggcatcccggtgagcagatcggcggcgtttcgctgccgcagtcggctcagccgaccctgaccattatcgataatccggcgaatccgacctacaagctgctgctggtggtggggaaagacgacgccgcgctgcgtgcggcggcctggcgtctgacgcgcggcaattttgatctgcaaaccgccagcctgccggtggaaccccagacgatcccgcagagcaaagcttacgacgcgccgcgctggatccctaccgatcgtccggtgaagctgtcagagctgatccgtaaagatcagagcctgaccgttaacggtatctggcatgacgccctgcgcgtcgccttccgcgccgcgccggatctgttcctgtgggatggcgaaaccattccgctgcgcatcggctaccgtttcccgtcggaaaactggatcgatgaagagcgctcgtggctgagtatgacgctgaatgacactttcctgcacaacctgccggttaacaagcagggcgcgctggaaaccctgtggcataagattggcggcgatgcgcgtcaggaacagttcgacatgccgctggagccgtacatgatttatggcgataaccagttgtcgctctatttcaatatcgtgccgaaggccagcgcgccgtgcagcgtgctgctgaacaacaacatcaagagccgcatcgacgatgactcctggatcgatttgagccacacgcgccacttcgcgctgttgccgaatctctcttatttcgtgggcgcatctttcccgttcacgcgactggcggactacgccgagacggtgctgctgctgccggaaaatccgaccgaaacccaggtggcgacgctgctggacatggccgcccgttccggtaacgccaccggtacggcgctgagccagaaccgcgtggtactggggatgccgacggcgggtactaatctgcaactgctgcgcgatcgcgacgtgctggcggtgaccggccttagtcagcatgacttcaatgctgaactgctgaagtcctcgccctttgtcgcccatgacaatcagctcagcgtccgcgagccgacgcagtgggaaaaaatccagcgctggatggcgggcgactggaacgccgagatcgtggaagccgatcgttacttctcctcgaacgaatcctggcgcggctttgtcagcttccgttcgccctggaacagtgaacgcacagtggtgacggcgctgggcagcaatgacgagcagcttgcccgtctgcacggcgatctggcctccgcccgcatcaacgccgggatccgcggcgatgccgcgatcattaccaatgaaaacggcgtgcgcagtttccgcgttggcccgcagtatccgcgcggtgaaatgccgctgcacctgctggtgatctggtatgccaaccagcactccggcctgctggcggtgcttggcctgtgctttagcgtggtgatcggcctcgcgctgtacgcgctgctaaaaagacgcgcgcgtaaacgtctgaatcctggggacaacgagtgaaaataatgaccataaaaaccgcccgcacgttatccaccctctgtgtttcgggcgtactggcgctggcaacggcggggatagcgcaggccgcgcccaatgacgcggtgctgaaggccttattcgaccaggccaattactggcatgaaaagtctcacgacgatctggcgaacgaatcgctgaagaaagtgttgatggtggatgccaataacacccaggcgctgtacctgatggcgctgtgggcgcagcagggcggcgatctgaaagcggccgcgcagtggcgcgcccggctggcggccgtatcgccggacgacagcgggctacaggcgctggataacgccaaacagctgtcgcaggtgccgcagggacaactgacgctggcccgccagcaggcgcgcagcggcaatattcccgccgcgctcgccacctggcgcagcctgtttaacggcgatacgccgccgcccagtctcgccccggaatactatctgaccatgggaagcgacaaagccatgtatccgcaggcgctcagtgagatccagcgattcgtggcgcaaaacccgcaggataacgccgcccgcgtggcgctgggcaaaatgctgacgtggcgcgaagagacgcgccgcgacggcatcatgcagcttgagcagatggcgagcggcaacaaagaggcggacgatggcctgcgtcaggcgctgctgtggctggggccgcaggcaggggatgaacagttttacgataactacctgcaacgccatccgaaggacagcgacgtacaggcgtattaccgcaaaagcatcggcggcgcggcgaaaggcgagggctataacgcgctgaacagcggcaacaccagcgatgcccgccgccagtttgagcaggtgctgcaaaccaacccggaagacgcggatgcgctggcggggctggggtatatcgcccagcgttccggcgactatcaggccgcggcgcaatatcttagccgcgcggccagccaggggggcgaggcctctgccgaacgtaaagctcaggctgaagatgccgccttctatggtcaactggcccaggcgcagcaggcgctgaaagagggcaacgtcagccaggcgctggcgttatccgcgccgctggcgcagcaaagcggcgagcgcggcacggcggcgaagctgttccgcgccgatgtgttgcgtcacaacaaagattatccgcaggcggagcagacgctgcgcgaggtgctgaacgatcagcctcagaatgccgccgcgcgggaaaacctctattacgtgctgcgcgatcagaataaagctgaagaagcgcagaccgtattacgcacgctgcccgccggtttacaggcgaaactgcaaccgcgcgtggtcaccggcttgccgggcgatccgatccgtcgtcaggcgcaacagctggcggcgagcggtaacaccagccaggcgattgccgtgctgcaacagggcgtcgcccgtctgccggacgatccctggctgcgtctcgatttagcgcgcctgctgcaaaaaaacggcaatgacagcgaagccagctcggtgatcgccccggcctctcgccctggcgcgggagccagttcgctgtatgcggcggcgctgtttgccagtgaaaacggtgcctggcaacaggcgcaaacgctgttgtcgcgtatttctccggccagtcagaacgggcagatgcgcgatctggcgaaacgggtgaactacaacctgcaaatggcgaccgccgggcgctatctggcgcagggtaatactcttgccgccgccaacacgctgaaaaccctgaccgccacgccgcctgaaagcccggtggatgcgggtaaactggcgcgtctgctggcgcaaagcggcgatctgactggcgcggtagcgctggtgcgggaaaacatgcgcgcgggggtgcagggcaacgccggggattatgccgatcagatcgccgtgctgaacaaggcgggcctgaacagcgaagcccagagtttcctggcccgtccggagattcaggcgcgcagcacgccgacgcaactggcaggcttacgcaccggttatgtcatcaatgaagccgatgcgctgcgcgagcagggtaactatgcggcggcctatgacaagctgatgcgcgccctgcaaagcgatccgcagaataccgatctgatgttcgccatgggccgtctctaccagaccggcaaaatgaacaaagaggccggggtggtctatgactacctgatgacccgcgacaccgacagccaggatgcgcgcgtcggtgcgattgacgtggcgctggcggaaaataatgtcgaaaaagccgactcgctggcccgcggtctgcgggcggataactctgccgaccggatgttgctgctggcccgtctggaagaggcgaagggcaaccatcagcaggccatgacttatctgcgcagcgcgcgcggcaagctggtgggcctggatgcgtcaaacggcgcggcgacgccgaccattggcggcgtgctggtggcggataaccccttcgtgcgcaccagtacctccgcggggcagacggcgtccgcatcggtttacggccagacgctgccgtggcaggtagcgcaggtggcaggtgaacctggcagtacgctgccgggcaccacccgcaccgatctgcctgtggaaaccgcccaggcgcgtacgctgcgtcaggtggatgacatgatgcagagcatggagcagaaaaccggcatgtggatgcagggcggcgtggaagtgcgtggacgcgatggcgaatccggcaccagcaagctgaccgaagccaaagcgccgttaacctggtccagctcgccctttggcgagtcgcgctttgagttcaccgccacgccaatcaccctgagcgcaggcagcgcctcgggcgacacctggcggcgctatggcactaaccctattgataatgccatcagcaatatctcctcatccattgagaatgcgcagaactccgtcgatccgacggcggcagccttcgccgatttgcagggctacaatgcggaaaatctctccccgctgaccgacactggccttgccaatctgaacagccttaatgaatccggtcgcctgaaggcgctcagcgtatcgaacttcaaatccagcctggataacaagataacctcctctaccgactcgcagaaagcgagcggcgtcgagctggcgatggcgctgagcggcgaaagttaccgactggatattggcaccacgccgctgggccaggatctcagtacgctggtgggcggcgtacagtggtcgccgaagctgaccgattatctgacgctgatcatcaaaggcgaacgccgcgcggtcaccgacagcctgctctcctatgtcggcatgaaagacgcctattcgggtaaaacctgggggcgggtgacgaaaaacggcggtaacgtacagcttggctatgatgacggcgacgcgggcttttatgtcggcggcggcggttacagttatctcggcgaaaacgtggccagcaacaccagcatgaacgccagcgccggggtgtatctgcgtccgttccacgacgattaccgccagctacaaaccggcctgaacgtcagctggatggatttctcgaaaaacctcagctactacacctacgggcagggcggctatttcagcccgcagaactacgtcagcgtctctttaccggttgattttagccagaaaatcaacaactggaagctcagccttggcggatctgtaggctatcagtcctatacccaggacagcagcgactacttcccgaccgatgccggggcgcaggggctgatgaaagagctttatgacctgggctacgcgcgtgattatcgctataaaggcggatcggaaagcggcatcggctacaccatgcgcgcgggcgtggattacaacgtgaataaaagcatgaccgtcggcgggaaagtcggctatgacaccttcggcaactataacgaaagcaccgccggactctatttccgctatttgttaggagacaaataaccatgacagtgaacagtcaacacgcgccgctgatcggctggtttcagcagcaacaaacgccgccgggctggtttgatctgctgaccattatgatcgacggtatggtgcgtaatgtcgggcaggtggagagccagccgttcctgcggcagatgggcgaaaccctggcggcgcagttcccgttgccgcccgctgaaaccgtcggcgaactggaggcgcatatcaatgcgcagctgcgtcattttggctggggatttatcgatattgaggccagcgacaccggcctgacgctgcgccatcaggcgatgccgatctcccgccacgaggagcagcaaacgcgctggtgccatgctttttgtgcaatacttgaaggtctttacgccagctggcttcagggccagggcggcgaggcgcatgttgcgttgcaacgcgaacgactgaattcactgtcagacgttctgttccgttatcacaacccacaatgagttgaactatggtcaagcgcgtatctaccgcgatagtcatgacggtgagtctgttatttaccgtatgcgcccaggcaggccctgcctgggacacctataaatcccggtttctgatgccggacggacgtattgtcgataccggcaataacaacgtttctcataccgaaggccagggctacgcgatgctgatggcggtcgccagcaatgaccgcgccagctttgacaagatctgggcctggacgaacaagacgctgaagaacaaggaaaacggcctgttctactggcgctataacccggtagagcctgatccccttgcggataaaaacaacgcctctgatggcgatgccttgatcgcctgggcgctgctgaaggctgacgcgcgctggcacgatgcgcgctataccgcggcgtcggatgccatcactaaggccattgtcgcgcatacggtgattaatttcgcgggctatcgcgtgatgctgcctggcgcgcagggctttaaccacaatagcgatgtgaccctgaatccgtcctattttattttcccggcatggcaggcgttcgctgagcgtagccatctcgtcgtctggcgtgagctgatccgcgatgcgaacacgctgaccgcgaaaatggcctggggggagtcgaagctgccggttgactgggtcacactgcatgccgacggcaaaatgcagcctgccagcaaatggccgccgcgcatgagctacgatgcgatccgcattccgctgtatgtggcctggcagaacccgcaaagcccgctgctaacgccgtggcgcaactggttcgggcagttcagcggcgataaaaacccggcctgggtgaacgtcatgaccaacgaaaccgcgccctataatatgagcggcggcttactggccgtgcgggatttagcgcttggggtgaagcacggcgaaccgcagatcgacgcgcaggaagattactattcggcaagcctgaaaatgctggtgtggctggcagagcaggagtgatttctcccctcaccccgtccggttttcaccggcacggggtgaagggaattcttatcactgcggatacggtacccagtccccgccgttcagccgtacgtacggcttatcctgatactggatcacaatcgcgttcgagttttccgataccggcgctgtctgcggcaggttgctggtcagttgatcccagttcacgctgtcttccacgaacagtttgccgtccaccgcacgaacgaccagttcagatatcgcgaggaagctgctcggctgatcgatgatcaacggagcgccctgatgcggggctttcataccgaagaacttaatgccgaccggcacgttggtgatcgacgggctcgggatgtcgcgcagaccggagacctgcattttatccccctgcaatgcgccgccgtgttccggggccatcaccaccatcaccttacgacctgatttttccagctgagtgaaaaacgcatccagttcatcaaagagtttctgggcgcgcactttatagtcagcggttttactgacgccagggaaatggttgccatcatgcagcggcagcaggttgaagtaagtggcggtgcgctgattgtttttaccttcttcagactccatccagcggttaagcactgccgtatcgtcatataccggcgaaccgtcgaacgacagcagcgcggtcggcagtccggcctgattcatcagcggcgcctgcatgccgccgttttcgcgcacttctttcaggaagccgccaaacacgccgttatgatcgagcataaactgcgatgagaagcccagtttcgccaggttatcgaacagatagcactcgttacccgcctgctgataaagatttttatgcgacggctgaccacagctggcgcgcagcaaacggatggccgccgggccgctgtaagaggtggcggagttaaagtgcttaaactgaatatcgaagtgcgaccacagcggatgcgacatcagtccggcggcttccacatccgcccaggagagggaacagatgttgatcaccagcagctcaaacggctgggcatcggcgggcagcgaggcggggaacggcgttttacgcttctcctcagcctgataaaaactgttcagccaggcatcaagattcgctgtagtcggtggcgctgtctgggcgggcataccgtcgacgaccggcttgttgcctgcgttggcgaccgtcgccgccgcattgccgccggtggtggtgaccgtggtggtcggctgacccgcaggccacagggaaaacgccgggccggtgagggtgatcaggttcagccagatcatgatggccaccacaaataccgtcacgcggatccactgcgccaggaacaaccatgccaccagcagtacaaagatcgcgccaagcatctgccagttgataaaacgcgtgaccaggtccagcagataatcggcgctgaatcccgccacctggctgccctggctcatcatactttgcggacccggcagccaggtatcgtgccagaacagcgcaaagccgataggaatggcgatccagtggcgcagtcgatgcagtttgcgttttggcagcggcatcagcaaaaacgccataaacaccagattttgcagcgcatggaaattaagatagcccgcccataacaggccgaacttcactaaaaaatagaagttccagccagaaagcccgcgccagtattgccacagcggcgacggcgcagagggagtataagattgattagtcatgttttcggtctgctttgacggtggatgcccggcgtaacgttccggcgggtttgacatatttcggcttaacaaacattagccggagtacggttctgatgcggcgcgacgaatgccgcgcggcgtaacccagcggaaagaaaatcagcgcgcacagcaccactaactgaataatatcgctgagagtcatcatgatgagcgctccgtcgtctcactgagcaggcggagaggttgaggaatacgccgccagctgcggccgtcgtgctccgcattcaggatcggattcgggccgtcggtcaccggcagcgggcgtgaccacttctccggttgcagcgtgcgcatgttcaccagttccgcggaaatctggttatcctcaaaccacaccatgcggttagaaaaaatatcggcgatgggcagcgggaaaatatggttgagcgcggtatcgagatcgttgacccggcagaaggataaaaacagcaccagccggttatcgccgatggtcataatgtccccgacgcggttcgggcggcacagcgtcagcgcctgctcgacgcggatccccggcaccggacgcagcgccaccagcacgcctttgccatccggcggcagtaatgtgttctgcatcatattgccgacggcatcgcagaaaatatcccacgtctggaaaccgcgcagcttcagcggctgcgtcatggtcaggagcgtggcgatctcctccggcacgtggcggttaaattgctggccctgcacgctttcaatcagcgtcagacagcgtgacaggggcgcattccacgggatcaccatattcgcgccgcagcctaataacaggcgttcatcggtggcgcgcaggctggcggtgttttcacgcacgatgattttcaacgcgctgccgcgctggcggcgcagcgagtggatctgccgcgcgaggttttcaatctgattattttgcgtgagcgagaaaatgaccgtcgcggcctgggtggtacgcgcttcttcaaacagcgcttcgttattatcgaacagcgtccagtattccgagagcggcggcgcgccttccagcagggcgacattacttaaaatgcgtttttcgtcgctgcgcggctgtacggtgggttcttcctggcgggctaattgccagccgtcgccgcgtggctccagaataagctgctggcgcgcgctgacgcctttttcgttacaccagaaggcaacgtcatacagatgaatatcctgctggctgcgcaaactggcgaggccatataatgagcgatattccgtcgtcagaaaggagaacagtttatcattattgttcccggggttaacgatcagcagcgtacaattgtggtatttcgaccacctatgaatattctcaagccatacacgtaatttatcattggatatattctgccaggcattactggcacacagcaggataaataaatggtgatgaggatcgaccgaacagagtaaatcaggggcaagcgagtatagactattttctttatccggcatgaaaaacagcctaattttttccggaccgtgatgctcgtccagtttgatgatattcttcggctccttgcccatgctgatcaccgcaaccttgctggcaccgggctgcgcggcaacggtctgattaaccagccttaccgcatcgtcgtcgcggtcagcgttgatccaccagacccctccggcaggcatatggcgcaattcgtcccacaaggagtgaatgccaatagaaaatatggggtccatcgcgtccctcttgttgcagatcgtcagttatctcagtttactagcgaaagcaaagaaataaacctaacattgaaattaaagagcatcagatttagcatgtaaacacatttttttcgccgggcaagtggataaattctttccagcagttttttattcaaaacgataggataaaaaatgaataataatgaaaccgctaattcgaaagattcaagcctgaactatacctggcagaatgattttctggcactcagtcgggtgttttcattgcctgaaatagattacaccgacatttctcaacgggaacaattggcggcagcgattaaacgctggccattgctcgctgaattctcccaactgccataaggaagccggaatggccattctgggattacagggcatacgcggcggcgtgggtacgacctccgtcaccgctgcgctgggctggtcactgcacatgcttggcgaagcggtgctgatcgttgatgcctgcccggataatctgctgcgcctgtcatttaacgtcgactttacccagcccgcaggctgggcgcgcgcgttgctggacgggcaggactggcgcgacgccgggcaacgttacacctcgcaactggatctgctgcccttcggccagctcaccgcaggcgaggcggaaaacgcgcacctgctgcatgacgcgttaagcggcatcgggccgatcctgcaaagcctgaaagcgcaaagccattatcagtggatcctcgtggatctgccccatggtcagacgccgctgacgcgcctgatcctcgaacagtgcgatcgggtgctgaccctcgtcaggccggataccaattgccacgtgcgtttacatcagcaggcgttgccggcggggacgcacattctgcttaacgatctgcgtatcggcagccagttgcaggacgatctgtatcaggtatggctgcaaacccagcgccacctgttgccgacggttattcaccgcgacgaggcgatggccgaatgtctggcggcgaaacagccgctgggagagtaccgcagcgactcgctggccgccgaagagatcatgacgctggcgaactggtgtctgctgcacgccgcgcaacctgccagcgggagtgacgcatgagccgtctttccacctggtttttgatccccccggttagcgaacgcctcggcgcgcgctaccagctttatcgcagccacggcgcgccagcgttcagcgccgccctgggctgcctgtgggcgatcctggcctggctttttctgccgctggaaaatccgcgctggcagtcgatccgcgaacgccaccgcgagctttacccgcatattcgcgccgaacggccgcgcccgctcgatccggcgcgttacctgctgcaaaccctgtggctgatggttacgcccgaacaggcaacggcaggcgcgccgcgcaaacgccgtcgcgcaggcttctcgcaattaatggcccgctaccatgcgtggctcgacgcgctgccgcagcgcttcagcgcccggaccagccatctggataatcagaaagaactggcgcacctgcatccgcgtctgcggcgcattattcttggtgtgatcgtggccttttccgccattctggcgctgctgtgcatcacccagccgtttaacccgatgtcgcagttcatcttcctggttctgctgtgggccgtggcaatgatggtgcggcgtatccccggacgcttctcggcgctgatgcttatcgtattgtcgctgaccgtttcctgtcgctacatctggtggcgttatacctccacgctcaactggaacgatccggtcagcctggtctgcggcctgatcctactgattgccgaaacctacgcctgggtggtgctggtgctcggctatttccaggtggtgtggccgctcaatcgtcagccggtgccgctgccgaaggatatgtctctgtggccgaccgttgatattttcgtcccgacctacaacgaagatttgaacgtggtgaaaaacaccatttatgcctcgctgggcatcgactggccgaaggataagctgactatctggatcctcgatgacggcgggcgtgaaaccttccgccagtttgccgagaccgtaggggtgaaatacatcgcccgtaccacccatgagcacgccaaagccgggaacatcaacaacgccctgaaatatgcgaagggcgagtttgtatcgattttcgactgcgaccacgtgcccacgcgctcgtttttgcagatgaccatgggctggttcctgaaagagaaagagctggcgatgatgcagacgccgcaccactttttctcgccggatccctttgagcgcaaccttggccgcttccgtaaaacccctaacgaaggcacgctgttttacggtctggtgcaggacggcaacgacatgtgggacgcgacctttttctgcggttcctgtgcggtgatccgtcgcgggccgctcgatcagattggcggcatcgcagtggagacggtgacggaagatgcgcacacttctctgcgtttacaccgtctcggctacagctcggcctatatgcgtattccgcaggcggcgggcctggcgacggaaagcctctcggcgcatatcggacagcgcatccgctgggcgcgcggcatggtgcagatcttccgcctcgataacccgctgttgggcaaggggctgaagctcccgcaacggctctgttatgtgaacgccatgttccacttcttatccggtattccgcggctggtgttcctcaccgcgccgctggcgttcctgttgctccacgcctatatcatttacgccccggcgctgatgatcgcgctctttgtggtgccgcatatgatccacgccagcctgaccaactccaaaatccagggcaaatatcgccactcgttctggagtgaaatttacgaaacggtgctggcctggtatatcgccccgccgaccatggtggcgctgtttgcgccgcataaaggtaaatttaacgtcaccgccaaaggtgggctggtggaggaggagtacgtcgactgggtcatttcccggccctacattttcctcgtgctgctgaatatcctcggtatcctggtgggcgtctggcgctatttctatgggccggagaatgaaattcttaccgtattcgtcagtatcgcctgggtgttctacaacctgatcgtgctcggcggcgcggtggcggtgtcggtggaaagtaaacagttacgccgcgctcatcgcgtggaaatctcgatgccagcggccatcgcccgtgaagatggccatatgttctcctgtaccgtacacgacttctctgacggcgggctgggcatcaaaattaacggccaggcgcaggtgctggaagggcagaaggtgaacctgctgctcaaacgcggccagcaggagtatgtcttcccggcgcaggtggcgcgcgtttccggtaatgaaatcggtctgcaactgatgccgttgaccacccgtcaacatattgattttgtacagtgtacctttgcccgcgccgatacctgggcactctggcaggacagcttcccggaagataaaccgctggaaagtttgatggatattctcaagctgggtttccgtggctatcgccaccttgcagaatttgcaccttcgtccgtaaaaatgattttccggtccctcacttcactggtttcctggcttgtgtcgttcgttccgcgccgccccgagcgggacgtggtagtacagcaaccgggttcgtgactggctcaacaatgatgataatgcgatgaaaagaaaactttcctggatgtgcgcagtggtaatgggattaagtgcatacccctatgcaatgacgatggcggcgcctgccagtccggcggctacggctgcgcccgtggtgccgacggtaacgcctgcaacacaaggggccgccacgccggcgccgacgcagccggaatccatgatgcccgtgacgccggtcgaagcacagaccaccccggtgggtcaggtcatgccgggcgtaaacggggcaaatgcgccgattgtcgccgataatgcgccaacccgcgacgttaccctgacttttgcgcagatcgcgccgccgccgggcagcatgatcctgcgcggcgtcaatccggacggcggcattgaattcggaatgcgcagcgacgaagtggtgtcgaaagcggtgctgaatctggaatacacgccatcgccgtcattgctgcccgtgcagtcgcagctgaaggtctatctgaatgatgagctgatgggcgttttgccggtcaccaaagaacagctgggtaaaaagacgcaggcgcaggtcgccgtcgatccgctctatatcaccgattttaaccgtgtgcggctggagtttgtcggccattaccgcgatgtgtgtgaaaacccggccagcagcaccctgtggatggatatcggccgcaacagttcactggcgatgacctaccagaagctgacgctgaaaaatgacttgtcctctttcccggtgcccttcttcgatccgcgcgacaaccgtccgctgaacctgccgatggtcttcgctggcgtcccggcgctggcgcagcaacaggcggcgagtattgtcgcatcatggttcggcacccgcaccggctggcgcggccagcagttcccggtctcttatgacgcgctgccggacagcaatgccattgtcttcgccaccaacgacaaacgtccggcattcctgcgtgatgtgccgccggtgaccgcgccgaccgtgatgatgatgaaccacccgactaacccgttcatgaaagtgctggtggtgttcgggcgcgatgacaaagacatcctgcaggcggcgaagggcattgcccagggcaacctgctgttccgtggcgaccgcgtggtggtggacgaggtgaaaccgctgctggcgcgtaaaccttacgatgcgcctaactgggtgcgtaccgaccgggcaatcacctttagcgagctgaaaacctatgaggagcagttgcaggccaccggcttacagcccgcctccatcaacgtggcgatgaatctgccgccggatctttatctgttgcgcagcagcggcattgatatgaacctcaattaccgttacaccgcgccaccgacgaaagataactcgcgcatggatatcagcctgaacaaccagttcctgcaatccttcagtctgaccagcagccaggatactaaccgtctgctgctgcggctgccggtgctacagggtctgctggatggtaaaactgaagtgtctattccggcgctgaaactgggcgcgctgaaccagctgcgcttcgacttccagtacatgaacccgatgccgggcggtacgatcgaaaactgtatcaccttccagccggtgcaaaaccgtgtggtgatcggcgacgactccaccattgatttctcgaagtattatcactttatcgccatgccggatctgcgcgcctttgccaatgcgggcttcccgttcagccggatggcggatctctctgatactctggtggtgctgcccgcgcagccaacggcggctcagctcaccacgctgctggattccatgggcggcatcggagcgcaaaccggtttcccggcggtgaacgtcaccctgaccaacgatggtaatcagctggcgaataaagatgccgatatcctgatcatcggcaccttaccggaaaaactgaaaaacgatgaacgtatcgacttgctggtgcaggccacgcaaagctgggtgaaaacgccgcagcgccagacagacttcccggccattgtgccggacgtcaatgaccgccaggccgacacgcagactgccgtcagctccagcggcccgatggcggcgatcgtcggcttccagtcgccctataacgatcagcgcagcgtggtggccctgctggcggacagcccgcgcggctacagcctgctgaacgaggcgatgaacgacagcggcaagcgcgccgccatgtacggctcggtgacggtgatccgcgaatcgggcgtgaacggcctgcgggtgggtgatatctattatgtgggtcatctgccgtggtttgaacgcatctggtatgcgctctcaaaccatccgatcctgctggcggtgctggcggcagtgagcgtcgtgttgctggcctgggtgctgtggcgtctgctgcgcatcatcagccgtcgtcgtcttgatggcgaccatgaataaattgcgataccggggtccgtcatgcgcaggttaacgctacgttttatcgccttatcgctcggcttctcggcgatgccgcttgtgcatgccgcgccggatgcgcaacagcaactgctggaacaggtgcaactgggggaggcgacaaaacgggaagatctggtgcgccagtcgctctaccggctggagctgatcgatccggcaaacccggacgttatcgccgcgcgcttccgttatttgctgcgccagggcgacaccgcgggcgcgcaaaaacagctcgacaggctacaggaactggcgccggactccggcgcgctgcgcgattcccgcaatatcatgacgctctccagcccggaagggcgacaggcgttgcaggaagcgcgtttgcagggcaccaccggccatacccaggaggcgctggctgcttacgataagctgtttaacggccatccgcccaccggcgatattgcgcgggaatactgggtgctggtagcgaaagtccccgcccggcgcaatgaagccatcaatcagttaaaagcgcttaacgcgcggcgtccgggagatggcgagctgcaaaacgccctcgcgcaattgctgtttgccagcaatcgcccggatgaaggctatgcggtacttcagcaaatggcgaaatccggcaccagccgcaatgccgccgccgctatctggtatcagcaaatcaaagatctgcccgtcagcgacgccagcgtacaggcgctgcaacgttttctggcgcagttcagcgagggcgataacgtcgatatggcgcgtcaacagctggccgaacagcagcagaagctggcggatccggcgtttcgcgcccgtgctcaggggctggcggcggtggatgccgggcagggtggcaacgccattgccgctctgcaacaggcggtcagcgccgacgcgagcgacggcgaagccactggcgcgctgggtcaggcatactcccagaaaggcgatcgcgcccgcgcggtagagcagctggaaaaagccattgcgctggcgccgcaaagcagcaaccgcagtaaatgggacagtctgttgcagaccaaccgctactggctgctgatccagcagggggacgcggcgctgaaagcgaataatccggcccaggcgacgcgtttttatcaacaggcgcagcaggtggataacactgacagctacgcggtgctggggctgggcgatgctgcgctggcaagaaaagagactgacagcgccgagcgctactatcagcaggcgctgcggatggacagcgagaacagtaacgcggtacgcgggctggcgaacctttaccgggcgcagtcgcccgagcgcgctgaggcctttattcagacgctgaatgcccgccagcggcgcagcattgacgacattgaacgcagcatgacgggcgaccgtctggcgcagcaggccgaaactctggaaaaccgcagcgactgggcgcaggccgctgaggtgcagcgtcagcgcctggcgctggatccgggcagcgtgtggatcacctaccggctggcgagcgatttgcgtaacgccgggcagcgcgcccagggcgatgcgcagatgcgcgatctggcggcgaaaaaaccgaacgacgccgaacaggtttacgcttatggcctgtatctctccggcaatgaagatcagggcatggcggcgctggcgcatctcaacacgctgccgaaaagccagtggacgcccaatattcaggagctggcggatcgcctgcaacggaatcaactgctggcccgcgctaatcagctgcgcgacagcggcaatgaaccggcagcgatagatctgctgaagtcgcagcccgcgtccacgcccattgatttaaccctggccgactgggcgcaacagcgcggcgattaccctgccgccagcgccttatataacgctgtgctggcaaaagagccggataatctggatgcccgtctgagcctggcggaagtggccgtggcgcagcaaaacccgatggaagcccgcgcgcagctggcgaaaatttccccgtcagccacgcagccattatccatgaataccgagcggcgtatggcgctggttgaggcgcgactggggaatactcgtgaggcgcagcagaccttcgccagactggtgccccaggcaaaatcccagccgccgtcgcaggacagcgcgctggtactacgtgatgccgcccggctttcgcaggcgacgggtgaaccgcagcaggcgctggaaggttataaagatgcgatggtcgccgccgggatcgccgcggcacgtccgcaggataacgacacctttacccgtctgacgcgcagcgatgaaaaagatgactggcttaagcgcggggtgcgcagcgatgcggcagagctgtatcgccagcaggacgtgaacgtcaccctggatcatgattatggccgctcagacgggacgggcggttattccgatctgaaaatgcacaccactatgttgcaggccgacgcgccgttagccgacggacgcatgttcttccgcaccgatgtcatcgatatggatgccggttctttcagcaagaacagcgacggcctgtatgatcctaactggggtacctgcggcgagttgggctgtgacaatatcgataaaaaacagagcgacaggggcgtaagcgtcgcggttggctggcgtaatgacacctgggacatggacatcggcaccacgccgatggggtttaatgtcgttgatgtggtgggcgggctgagttacagcagcgatctggggccagtcggttataccctgaacctgcatcgccgcccgatctccagctcattgctggcctttggcggacagaaggacgccagaggttatcaatacgatccggacgatgaagataataaccggggcggcaccgggaaaacctggggcggcgtgcgggccagcggcggtggcgtcagtatgagttacgatcgcggcgaagcccacggcgtgtgggcgagtctgaatgcggacactctgaacggcaaaaacgtcgaggataactggcgcgtgcgctggatgacgggctattactacaagcttatcaataaagacaatgagcgcatgaccgtcggcctgaacaatatgatctggcattacgacaaagatctgagcggttatacgctgggtcagggcggttattacagcccgcaggagtacgtctcttttgcggtgccggtgacctggcgcaaacgcacggaaaactggtcatgggagctgggcggctcaggctcatggtcccactcacgcaccaaagcgcaggccagttatccgcgcttaaatctcatcccggcagaattccggcaggatgcccgcgatgagggtagcgaaggcggcagcagccagggcttcgggtatacggcccatgcgctggtggaacgccgtatttcatcgaaatggtcaataggcgcaggtattgatattcagcaggcgaaagattatacccccagtcacgggatgatctttgttcgctactccgatgcgggctggcagggcgatatggatatgccgccgcaaccgctgatgccttacgctgactggtaacgggaatctagaattatcttatatcccccggacagtctcttaatgatgccgctatagggtatactctggcggcggtaaggtaacagcaggttacttttcgtgttaagggtattccggagaaacaatttgcgcgtcagccgttcattaaccataaaacaaatggcgatggtgtcagccgtctctatgctgtttgtgttcattttttgcgtcattttgctctttcattttgtgcagcaaaaccgctataacacagccacgcagctggaaagcattgcccgctcggtgcgcgagccactctcatccgccattctgaaaggcgatattgttgacgcggaaaccatcctgaaaggcattcagcctgcgggcgtggtcagccgtgccgacgtagtgctgcccaaccagttccaggcgctgcgcatgcgctttattcctgaacgcccggtgccggtgaccattacccgtttgtttgaactgccggtacagatttccctgcctatttattccctgcaacgcccggcgaatccccagccgctggcgtatctggtgctacaggcggattcgtaccgcatgtataagttcgtaatgagcgcgctgtcgacgtttgtgacggcttacttactgcttacgctgatgatcaccgtggctatcacctggtgtattaaccgtctgatcgttcatccgctgcgccgtatcgctcgtgaacttaacgatctgccccagcatgagttgccagggcatcaactggcgctgccgcgtcatcaccatgatgatgaaatcggcatgctggtgcgcagctataaccgccatcagcagctggccttgccgcatcacgacgacgcgcgctatccggtcgctggatcggcgcataaagcgattcttaccgcactggataatcaccagtacaccatctggctgcaaccgcaggtaaatctggcgaccggtaccctgctgggggcggaagcgctgctgcgcgtgcgccagccggacggcagctggacgctgccggaagggcttatcgagcatatcgaaaataccggtctgatggtgactgtcggttaccgggtgctggaagcggcctgtcgccagctggcggcctggcaggggcgcggtattatgctgccgctgtcggtgaacctttcggcgctgcaactgatgcatcacgcgatggtgccggatctgctggcgctgttaagccgctatcgtattgcgccgggtacgctcatcctggaagtgaccgaaagccgccgtatcgacgatccgcagacggcggtggggattttacgcccgctgcgtaacgccggagtgcgtatcgcgctggatgattttgggatgggctacgcgggcctgcgtcagctgcaccatatgaaatcgttgccggtggatctgttgaaggtggataaaacctttgtggaagggctgccggacgataacagtatggtgtcggcgattatccatatggcgaacagcctggatctggagatcattgccgaaggcgtggaaaccgacgctcagcgcgagtggcttgccgccgctggcgtgaccatggcgcagggatttttattcgcccgcgccatgccgccggacgcctttgaggcgcgctatttttccgcctcgccggaagatgaaaaagaatagtctgttttacacttgtgcgagtcagctcaaatttcttaacattattgtttcaaatttgaagtaagtttatttctgtcatgtttatcgggtgttattttaaagccgcaggcaaacctaaaccctacaaggcctgtggtttttacttcaaggacaccctatgaaaacctcactgtttaaaagcctctattttcaggtcctgaccgccatcgccatcggtattttgctcggccatttttatccggaaatcggcgcgcaaatgaagccctttggcgatgccttcgtaaaactgattaaaatgatcatcgcccccgtcatcttctgtacggtggtcaccggcatcgctggcatggaaagcatgaaggcggttggccgtaccggcgcggtggcgctgctgtacttcgaaatcgtcagcacagtggcgctgattattggcctgattatcgttaacgtggtacagcctggcgcgggcatgaacgtcgatccggcgtcccttgatgctaaagcggtggcggtctatgccgaacaggcgcagcagcagggcatcatccccttccttcttgatattattcccggcagcgttataggcgcgttcgccagcggcaatatcctccaggtgctgctgttcgcagtgctgtttggttttgcgctgcaccgtctgggccacaaaggccagctgattttcaacgtgatcgaaagcttctcgcaggtcattttcggcatcatcaatatgatcatgcgtctggcccccattggcgcctttggcgcgatggcctttaccatcggtaaatacggggtcggtacgctggtgcagctgggccagctcatcgcctgcttctatatcacctgtatcctgtttgtggtggtggtgctcggctctattgcccgcgccacgggcttcagcattttcaaatttatccgttatatccgcgaagaactgctgatcgtgctcggcacctcgtcgtcagaatcggtgctgccgcgtatgctggataaaatggaaaagctgggctgcaaaaagtcggtggtggggctggttatcccgacgggctattcctttaacctcgacggcacctctatttatctgaccatggcggcggtatttatcgcccaggcgacgaacagccatatggatattttccatcagatcaccctgctggtggtgctgctgctgtcgtcgaaaggcgcggcgggagtcacgggcagcggctttatcgtgctggcggcaaccatttcggcggtcgggcatttaccggtagccgggctggcgttgatcctcggcatcgaccgctttatgtctgaagcccgtgcgctgaccaacctggtgggtaacggcgtggccactgtggtggtggcaaaatgggttaaacagcttgatgaaaaacagctgacggatgtgctcaataagcgtgcgccggacggcaaatcgcaaaaaatctcctcataatttcgccacttagacccgtcgtcccttgtggggcggcgggctcctgcgcataattacccaaaatttcacttcccggcgtgacgtttcgctttttacgctgtctaacacgaagtgtttagtcgtcatctcttagactgcccggcaatgaggcggtcatttaaccaggaatgttgatcaggggttcacatgcagggcacaaaaattcgactcttcactggcggcgtgctgatgatggttgccgccagtcatgtgcaggcagatgcgctccagcccgacccggcctggcaacagggaacgctggcaaacggttttcagtggcaggtgttgtccacgccccagcgccccagcgatcgtatcgaaattcgcctgttaattaataccggctcccttactgaaagcacccagcagagcggcttcagccattttattccccgtattgcgctgacgcacagcggcggccttgagcctgcccaggcgcgttcgctatggcagcagggcatcgatcccaaacgcccgctaccgcccgcgatagtttcttacgaatacacgatgtttaacctgagcctgccgaataaccgtaacgatctgctgaaagagtcgctggcttatctggcagataccgcaggcaaactcaccatcaccccggaaaccgtaaaccacgctctcgccagccaggacatggtggcgacctggccgcaggatacgaaagacagctggtggcgttaccgtctgaagggctcgtctttgctgggccacgatcccgccgacccgctcaggcagccggtggataccgaacaggtgaagtcgttctaccagaagtggtacaccccggatgccatgacgctgatcgtggtgggcaatatcgacagccgcgccgtttccgaacaaatcaacaaaaccttcggcgagctgaagggcaagcgcagtaccccggcgccggtgccgaccttatcgccgttaccgcgtgaatccgtaagcattatgagcgacgcggtgcgccaggatcgactctccattatgtgggacaccgcctggcagccaatccgcgaatccgccgtgctgttacgctactggcgcgccgatctagcccgcgaagccttgttctggcatgtgcagcagacgctcagcaaaaacaacgctaaagacattggcctcggctttgactgccgggtactgttccagcgcgcccagtgcgcgatcaacgtcgaatccccgaatgacaagctgaacagcaatcttggcgctatcgcccgggagctggcgaaagtgcgcgataacggcctggcgcaggaagagttcaacgcgctggtggcgcagaagaatctggagctgcaaaaactgttcgcgacctatgcccgcaccgataccgatgtgctgatcagccagcgtatgcgttcgctgcaaaatcaggtggtggatatcgcgccggaacagtatcagaagctgcgtcaggatttcctgaacagcctgacgctggaaatgctgaatcaggatctgcgccagcagttatcacaggaaatggcattgatactgctgcaacctaagggtgagcaggaggtcaatatgaaggatttgcaggccacctgggaaaacattatgtctcccgccacccatgcgcctgtcccggtgaatgacgatacgcatcaggacgtgtcggatattccgccggcccagcgttagaaataaccctctccccaggggagaggggatttatttttactgcggcatcgcctcgcgcggaataatcgcgccgcgatactggatcaccgtactggccgtcagatgcccgcgtctggcggcagcttccgcatcgccgcccgtcagacgcaccgccagatagcctgcgctgaacgaatcgcccgccgcggtggtatcaatcactttctcttttggcagtttcaccgccggtacatcaatcaccgcttctccggcgaccgacaccaggcaggactctgcacctcgtttcaccaccacttccgtcacacccgccgcatgggtacgggcgatgacgtcttcaaccggctgctgtccccacagggcgtcttcatcatccagcgtcaggaaggcgatgtcggtgcactccagcatctgctggtacacctgctgcgtctcttctttgctggcccacaggcgcggacgatagttgttatcgaaaatcactttaccgccgttggcgcggcattcacgcagcaacgacagcagtttgtcacggctggccgggcttaagatggcaaggctgataccgctcagatacaggtaatcaaaggttgccagctcttcgcagatggcggcagactgttcgctttccagccagaattttgccgccgcttcgttacgccagtaatagaaggtgcgttcgccggtgctgtcggtttcgatgtaataaagacccggcaggcggttttccatgcgctgcgtcagatccgtatccaccttttcactctgccaggcgtccagcatctgctggctgaaattgtccgtgccgagggcggtaacgtagtgcaccgtcagcgcttccggagcgacctggcgggcgatataaaccgaagtatttaaggtatcgccaccaaagccacggttaacttcggagcctttttgtgacagttcaatcatgcattcgccaatgacggcaattttcctggacatagtcgtaacctgaatcggagtgatggacagtagtttgcgttgcgggtgtttcatggtcaatcatattaaaacaacgttccataaattttttgagctggcgcgtataacgtgcagattctgctgcctgattttccatattgccttttaagtgaacataaagttctgtccctccccgccgataactcaaggacgagttccgacaggccactcactcaatcaacaggacagactgataatgaagttaaagcaggttatccagcggctaaacattccggaggcgagcattgaaagcttgcaggagcgacggtactggttgcagtgcgaacgtgcttatacttatcagccgatctacaaaaccgatggccatctgatggcgattgaggtcctgaccatcgtcacgcatccatccgatcccacacaacgcattgcgcccgatcgttacttcgcggaagtggcggtgcgtcagcgtgttgacgtggtggaggagcagatcacgctgctcgcccgtcagcatgatttttttatgcggcacggcattctggcatcggtgaacgtcgacgggccgacgctgctggcgatgcgccagcatgaatcgttgatcgatctgattaacacgctgccgtggctgcgtttcgagctggtggagcatatccgcctgccggatgacgtctcctttgcggcaatctgtgagatttgcccgctgtggctggatgatttcggcaccggcatggccaacttctcggcgctgagcgaagtgcgttacgactacattaaagtcgcccgcgatctgttcatcatgctgcgtcagaccccggaaggccgcaatctgttcacgcagttgctgcaactgatgaaccactattgtcagggcgtgatcgtggaaggtattgaaacgctggaagagtggcgcgacgtacaggcctcccctgcggcagcggcgcagggctatttcctctcccgtccggttccactggaaaatctgcatcgtgtgatcctggccctgtgatgctggcggtaatatcccgctgattacgcagtcattctgccctttttgtcagcctcagctatctttaaaagaggcaggaaaagacaggaaggaagcaggaatgactaaaacaggcaaaattataaccgccgtcattggaaccctcgtattgttgatcgtcattgcgatcatcgtcattgcgacatttgactggaaccggctcaagcccaccattaacgaaaaagtctcaaccgagctgaaccgtccctttgccattcgcggcgatcttggcgtggtgtgggagcgccagaaacaggaaaccggctggcgcagctggatcccctggccgcatgtgcacgcggaagacgtggtactcggcaaccctcctgatattcctgctgtcaccatggtgcatttgccgcgcgttgaagcgacgctcgcgccgctggcgctgctcaccaagaccgtttacctgccgtggatcaaattccagcagccggacgcgaggctgatccgcctttcggaaaaaaacaataactggaccttcaatcttgccagcgacgacaagccaaaagatgaaaacgcgcagccatcgtcgtggtcattccagctggacaacattcttttcgatcgtggccgcattgatattgacgataaggtcagccgcgcggacattgagatccttgtcgatccgctgggcaaaccgctgcctttcagtgaagtcaccggatcggataaagacaaaaacgccaaagtcggcgactacgtgttcggcctgaaggccaaaggacgctacaacggacagccgctgaccggcagcggtaagatcggcggtatgctggcgctgaaaagcgaaggcacgccgttcccggtgcaggcggatttccgttccggcaatacccgcgtggcttttgtcggtacggtgagcgatccgatgaaaatgggcggcgtcgatctgaaactgaaattcgccggggattccctgggcgagctgtacgatctcaccggcgtcctgctgccggacaccccgccgtttgaaaccgacggccgtctggtggcaaaaatcgacgctgaaaaaacctcggtttacgattatcgcaactttaatggtcgcatcggcgacagcgacattcacggctcgctgacttacaccaccggcaaaccgcgtccgaaactggaaggcgatctggaatcccgccagctgcgtctggcggatctggggccgctgatcggggttgataccggtaaaggcgcagagcagtcaaaacgctcggaagagaaaaaaggcgagaaaactaaccagccggcgggcaaagtgctgccctatgaccgcttcgaaaccgacaagtgggacgtgatggacgccgatgtgcgcttcaaagggcgtcgcattgagcacggcagttcgctgccattgagcgatctttccacgcatatcatccttaaaaacgccgatctgcgtttgcagccgctgaagttcggcatggcgggcggcaccatcaattccaatatccacctggaaggcgataaaaagccgatgcaggggcgggcggatattcaggcgcgtcgtctgaagctgaaagagctgatgccggatgtggagctgatgcagaaaaccattggcgagatgaacggcgacgcggaattccgcggcaccggcaactccatcgccgcgctgctcggcaccagcaacggtaatctcaagctgctgatgaacgacggcgtcatcagccgtaacctgatggaaattctcgggctgaacgtcggtaactttattgtcgggcagatctttggcgacgacgaagtgcgggtgaactgtgcggcggcgaacatggatctggttaacggcgtggcgcgcccgagtattttcgccttcgatacggaaaacgccattatcaacgttaccggcaccgccagcatggcgtctgaacagctggatctgaccatcaatccggaaagtaagggcatacgtatcgtcacgctgcgatcgccgctgtacgtgcgcggctcgttcaaagatccgcaggcgggcgtgaaggctggtccgctgatcgcccgtggtgcggtcgccgccgcgctggccacgctggtgacgccagccgctgcgctgctggcgctgatctccccgtcggaaggtcaggaaaaccagtgcagtaatattctttcgcagatgaaacgctaagaaagtcccctttcccgccaggggaaggggttattcgcggcacagccattgcgttgcgccctgagtaatgagcgccgattgccgcggcgtcggcggtcggtcgctgaccacaaaatcgaagtctgacagggtgccgttctggcagacggcggtgcggccaaacttactgctgtccaccaccagcacggttaacgccgcgctcgccaccagcgcatgacgcgcggccacctcatcatcgttaaaatcgaacagctcccccgcgtcactgagtccgccaacggataccacgcccatatccacccggtagcggctaaaaaaggccagcgcatcgccgccaatcacatctaaatcacgcttacgaattcgccccccggcaattgtcagcgcgcactgttcccgctgactgagcggcaacgcggcgtgcagattattggtgaacaccgccagacgggaatcagcgggcagcgcatgggccaccatttccaccgttgtgccggtgccaagaaaacagctttgccagcggctcagcagttgcgcagtgcgctcgccgatccagcgcttaccgctaatattcacaatctcccgctgctgataaccaatattttcgcgcgcgaaaggggcgaccacaccgtgacggcgcagcagcaaaccctgcgaggtgagcgtgcgcaaatcgctgcgtaccgtttgcagcgatacgccaaagtagtgggccagctgttcaatgctgatttcgccgcgcccggtgaccagttcaacgatggcagtccggcggatttctggagtcatctcactttccttcaatacgatttcccacaaggttaccgcgccaatatgaaaatattactacgaaaggagatggtcatatttttgtcagattggcctgttttaatcatcacaacgaaaaccgaggggaaacggaaatgagtaaaaaattagcgctggcggccgttgtactggcaacactgagcggacaggcactggcaaaaagcacgctcacgctctacaccagccagccgagtgaagacgcgcaaatgacggtcaatgcgtttgagaaagcgcacccggatattgaagtgaaatggatccgcgacggaaccaccaaactgaccgcgcgcttacaggcggagatggcggcaggcggcgacgcgccggatgtgctgctcatcgctgacagtgtaaccatggaatccctaaagcagcaggatttgctggcggcctatcactccccggaagccagtcgctatgacgcgcagctgtatgataaagcgggcttttactacggcaccaaactcatcactaccggcatcgcttatcacaccaaagcgccagtcaaaccctcatcctggcaggatctgctgaagccggagctgaaaaatatgaccacgctgcccagcccgctttactccggcgcggcgcaaatccatatggccgcattgatgaacaccccgcagctgggctgggcctattacgaaaaactgaaagccaacggcgcgatgccgcagagcggtaacggggcggtgatgagcgccatcacctccggcaacaaagcctacggcgtgctggtggattacatggcgatccgcgagaaagcaaaaggcgcgcctattgatttcgtcttcccgtcggaaggcgtcagcatggtcaccgagccggtggcggtgatgaagagcgccaaaaatccgcaggcggcgcacgcctttattgatttcgttctctccgacgcggggcagcgactggtgctgcaacagggctatctgcctgcggacgcccgcctgccggtacccgccggtttcccgccgcgcgacagcatcaaactgatgccgttcgatgccgccagagcgctggccgacgcggagccgaacaaaaaacgcttcagcgatctgtttggcagcaaataaccgatgagcatcatgacccttcgtcaaccgaccagcagcggcccgccgaaagggctgctgtggttattgctgtgcattgtggcgctgctgagcctgttgcccagcctgcgtctgttaatggccgcgctgctggactggcagcagggcagcaacagcagtttaggccgcgtgctgagcaatccatcgacctggacggcgctctataacagcctctataccagcgggcttggcacgctgttgtcgttgctgctgggcagtctgttcgccttttgtctggcgctgaccaacatccgcctgaaacagatgtgggtgttcctgtttatgctgccgatgatgatcccgccgcaggtgacggcgctcagctggctgcaactctttggccccggcagcattctgctgaacagcattggccttgcgccgtcgttcggcagcccgaatccgctctattccgccgaaggtatcgccctgctgctggggatccagcatgcgcctctggtctttctggcgctgcgcacccagttgcagtgtctgcccaaagagcagatcgaggccgcacggctgaacggcgcgtcgctgtggcgcgtgttcgtcgatattgtgctaccgctgtgccgcaccgcgctgtgggcgggggcggcgattgcctttgtttccgcgctcggcaacttcggcattccggcgatgctcggtattcccatctcgtatttcgtactgccgatccagatttaccagacgctctccagcttcggcccgtcaatgctcagtgacgtggcggcgctgtcggtgctgatgggcgtgctggcgattggcattgtgtccttacagggcgtgatgcagcgacgccacgcgctgccgttgatcggcatggcggggcggtcgctggatttccagctgggtaaatggcggctggcgacggaatcgctgctggcggtggtgctgttcgccattttgctgctgccgctgctggcgctgatcgccacctcactggtgccgactctcggcgtaccgctcaatagccaaaccctgacgttcgccgcctggcatgcgatgttcgataaccagagcgccacctggcgcgcgctcaccaacagtatggtgctgtcggtttccgccgcgctgctgctgatgctgatcgccctgccgctggcctggctgctggtgcgctacgccagtcgcccgctgcgctggctgcaaaacgccatcgatattccctacaccctgccgggcgtggtgctggcgatcgccattatcctgctgttctcgcgcccgctgccgctgcttaacgtcagcctcagcggtacgctgatgatcatcttcatcgcctatctggcgcgctttctcaccgtctgcctgaaaccggtgcataacagcatgctgcaactggatccggcgatggaggaggccgccagcctcgccggcgcgaatttttcccagcgtctgcgccatattgtgctgccgttgctggccccggccgcctttgccggcgcgctgctggtctttctcaccgccgtgaatgaactcaccgtttcggcgctgctgtggagcgcaggcaaggagaccatcggcgtggtgattttcaacctcgatgagagcggcaataaagtgctggcgtcggcggtgtcggtgctggtggtggcgctggtgacctgtgtgatgttgttattaagcggcctgggtcgctatcttcccaaaggagttatcccgtggcagaactgaaactggaggggcttggcaaaaccttcggcgaacagaccgtggttcgcgatctgcacctcaccattccgcagggggcgtttacggcgttgctcgggccgagcggctgcggcaaaaccacgacgctgcgtattctggccgggcttgagcatctgagccacgggcggttatggctcggcgatcgcctgctggcggatgaaaaaatccatctgccgccggaggtgcgcaacatggggatggtgtttcagtcctatgccctgtggccgcacatgacggtggcggaaaacgtgggctatccgttaaagctgaaaaaagtgcagggcgcggcgcgacagaaacaggtgatggcggcgctggaggtggtggagctgggcgcgtacgccgaccgttccccgcaggcgttaagcggcgggcagcggcaacgggtggcgctggcgcgctgtctggtgtcggagccgcaggtggtgctgcttgatgagccgctggctaacctcgaccggcatctgcgcgccaccatggagcagacgttccgtgaatttcatcgccgtaccggcgcgacctttgtctatgtgacgcacgatcaggccgaagcgatggcgctggcaagccatatcgcggtgatgcataaaggggagctgatgcagtggggcacgccgcaggggctgtatcagcatccgcacagcgcctgggtggcgcgttttatcggcaaaggcagcgtgctggacgtcagggcgcaggctgatgaccgccagcttaacggcggcgaattgcaccgggcattaagcgccggggccgcggggctgtgtcagcaggtgctggtgcgccccgagcatgtcgaagtggcgcaggacggcctgcatgctgaagtggagagctgcatttatcagggcgagcgttatctgctggcgctgcgtctggcggacggtcagcagctgagcgcgtttcaccattcgccgctggatgtacagcaggcggtggcggtgcggctgcatcagggctggcgtctggaggccgcgtgaactttcgcatcgagatcatcagcggacttaaccagaaagcgcccgccgccattttactcagcacgccgtcgcagcgcattttgctggatgcgggcggggcgcttgatacagagagcgacgactgggcggtgccggataatctggatgcggtattgctgagtcacgatcacattgatcatatcgccgggctgtgccatctgccgccgcacgttccggtttactgtagcgcggtgacggcccgatcgctgcccgcgcaccgctctgttcaggtgattgcggtacgtggtcagttccggcttggcgatcttaccgtgactaccggcagttgcggccatgcctatggcggcgtctggtttcatttcgatgtaccgggcggtctgttttacagcggcgatatcagtatggagtcggcgctgtttcgcttcgatcccccgccgcgcgcagagattgcgctggtggatgcctcttacggattgtatgacaccccgcaatcgcagcagcgcgcgcacgttgccgcgtatctgcgtcagccgactttatgcccggtgccgccgtcaggtcgcgcagtggaaatcgcgctgcttgaagcgcaggctggacggctggcgatgacgctggacgacgactgccgggcgatgctgacggcgatggcagagtacgatgacggcagtttacagaccggcgtgcaggcaggcttacgcgcgctgcgccagcaactgccgccgttttccgtgaccgcgccgctgatcctcgccgccgatcctgacggacaaaccggcatggccggggcattacgcgcgcagccggatttttatcatcgcaccctttttaccggccacatgaacccgcgcgcccgccagcagtggcagagcggcgaggtggacttttgccgctggaacgtccacccgacgcggcgctgtctgcaacgtctggtgatgatgctcggctgtcatgcgctggctccgctgtttacgcctctggacgatgtgtcgcgctggcagcaggcgctgggctgcaccatcatcaccgacagcaccattgagagggaagtatgtcattaatctgtaagccgtttgtgctggtgcgccacggcgagacaccgcttaatcttgcacagcggatcggggggcgcagcgatgtgccgctgaccgcgcgcggcgaagaacaggcgcgtgccgcctcggcgctgctgatgcgccagcgctggagttgcattgccgtcagcccgttgctgcgcgctcgtcgtaccgctgaactggcgctgccgggccagcccctgaccctggtcgacgatctgcgggagcgggactggggtgacctggaagggatgcccattgcctcgcaaccgccctatgaacagacgccgccgcacggcgaatcatggcaggcattttgcgatcgcgtcaccagcgcgctgaaccttctgcttaccgcccacgagacgccgctgctggtggcgcattccgggatcttccgggtcattaatctgtatgccaccggcacgccatacggcgaacgtatggggaatgttgtaccgatgtggatcatgccaggcctgcgggctggcgaatgggaaattgtcccgctggaggaacgttatgtcgtatgaagagtgcgtgattgtcgatattgacggcacactcgccgaatttgatgcagaagctgtgcgtcagtgggtactgggcgaagagaagcagtggctgccgttttttgaacatatggcccaggcgctgccaggggtggcggtagcccgtcttgttggcatcctcagcgctcagcagcaaaaaatcgttatttgcagcggacgcccggccagttatcagcactacacgcagacatggctggagcagcacagtatcccgtttgatgcgctctatctgcggccggacgatgaagatcatcttgctgatgaagtggtaaaaaagcgcctgttgcagcgcattcgcgaggatggttatcagccctggctggtgatcgatgaccgccaggcggtggtggatttctggcgggccgaagggctgacctgcctgcaatgcgcgccgggggatttctagctgtcagggggcttccattaaccggctgatgtgaatactcagccaggtcagctcatcctttggcagtgtgagctgatatttttcctgcacatagtcgcggatcgcccaggcgacgttcatggcgtccgggcgatggcgcagcagttcctgatagaaatcgtcggtgtcactggcagtgacgttgccggcaatcagccgctcggcaaagtagcgcaggtgggtaataaaacggttgtagtttaccgagttgatgtcgagatttttattgagcttatagcgcacgatctccgcgatgcggttgaccagttccacctgctggtgggcgctggcctgatcgctactgcccgtcgcgttgataatatgaaaagcgatattcaccgcctcatcatccggcagcgtgacggcaaagcgggcgttcacctgctgcatcgcctgctggcctaacagatactctttctgataataccgcttcacttcccagctgagcttgttaaaaaacggctgatctttacggcagcgttctacggcaaaccacaggtgctcggcgagggtaaagaacagcacggcgttgagcttttccacatacgcctgctggatctgcgtgatgatgtcgtgggtaagctcaaaaaaagccgcaggaatggtgtccgtcagcgataaaaagtgccgggatttcagatccgccagcggcaggaagatcttttccacctgcgcaatgtcgataagctcgccgggtttgctgccaaacccgatgcccttaccgaacaggatcatctcctgctggtcatagtcgaccagcagcatactgttattcagcgacttttttactgttatcacggtcaattcctgcggctttacagccgttagtcgaggtcggccccgttgctggcgatcactttcttataccaccagaacgagtctttacgcagacgttccagcgagccattaccttcatcatcctgatcgacatagataaagccatagcgcttagacatttgcgacgtcccggcgctgatgatgtcaatcggcccccaggtggtgaagcccatcacctccacgccttcgttaatcgccgccagcgtttgcgcaaagtgggcgcggaaatagtcgatacggtagctgtcatggatttcgccattttccaccacgtctttcgcgcccaggccgttttcaacgataaacagcggttttttatagcggtcgtaaagctccagcagcgagattttcagccccacgggatcgatctgccagccccactcggacgccggaagatgtgggttcttcacgccaagaatggtgttgcccggcgtgcgctcgacgtctggctgggtgctttcagtaagagacatgtaatagctgaacgacacgaaatccacggtatgggctttgaggatcgccttatcctccggctgcatagcgatatgaatgtcgcggcgttcgaggtcgcgcaaaatcagcggcgggtattcgccagacacctgcacatcggcatagaagtagttttcgaggtttttcttcagcgtcgcttccacatcctccgggcggcagctgtagggatacgtggtcagtttggtgagcatacaacccacctggctgccggggattttggcatggcagtcgcgggtcaccagcgccgaggcgacaaactggtgatgcagcccctgataaatatcctgcttcgccttgcccggcgcgcttttatcttcgcggatccccgcagtggtaaacggatggcgatggatgctgtcgatttcgttaaacgtcagccagtaacgcaccacatctttatagcggtcgaaacagacatttgagaagcgcacaaaggcgtccagcacgttgcggtgcacccagccgttatatttttcgctcagcgccagcggcatttcataatgcgaaagcgtcaccagcggttcaatgttgtagtggcgcagctcgcggaacagatcgtcgtaaaattgcaggcccgcctcgttcggctcagcgtcttcaccggtggggaaaatgcgcgaccaggcaatggacacgcgcagcaccttaaagcccatctcggcgaacagcgcaatgtcgcctttatagcggtggtaaaagtcgatgccgcgccgtttcgggtagagcgcgtcgttttggccggttaaggcatcgctgacgttttcatcgctcagcgccaggtgaccatcatagcttttcagggaaagattcggtttccaggtgatggcgtcggccacggatggccctttgccgtcaacattccacgcgccttccgcctgattcgcggcaatggcaccgccccataaaaaaccctgcggaaagccagaatatttatccattacacggactcctttaacgtcatgatgatgtgaggatgagtggattgcgccccgcgcgcggcgggggcaatggcaaagcgttcgctgttggtgacgatcatcatcaccaccggatcgaatccggccgccacgatgtcatcaagatcaaaacggaccagaacatcgccggtgctgacgtgctggccttcgctcacctgcgggtgaaagccctgaccgttcagtttgatggtgtcgataccgatatgaaaaatcagctccacgccgtcatcggtcagcagactgaccgcatggcccgtgtcaaaaacgttcatgatggtgccgctggcaggcgcacgcagtatgccctgcgaagggatgatggcgatgccgtcgcccatgatgcgctttgagaagacatcgtccgcaacgcgctccagcgggatgattttcccctccaccggcggcgcgaaatccagctgacgttcagcggcctgcggcgttttatcccgccacagcagcagggcggcgaaaaaggcaatggcgaaggacaggccgccaccggcaaaggcccagagaatattcatgggattggttggtgagacgaacatggagatgctggcaaggccggggccgaccagcgcgaaggcttcaatcgccatccagccgataaaggcgccgccaatcacgctaccggcaatcacgctatagagcgcttttttatgcagcagcgtgacgccgtaaagcgcgggttccgtaatgccgaacagggcggaaatcccggcggaaatcgccgtggatttcagcgccctgtctttgctcttcagggcaatggcaaaacaggcgccggattcggcgatgttatgcgccagcgacgcgggcaggtagagcatttcgcgcccgaactggctcatcgacgccacggcgtaaggcagcatgggtttgtgcattccggcggccaccataaagggtaacgccgctgccagcaggcccgtcgccacgaatcccagtttgccgtagagccataagatcaccgttgccagtccggcccccagttcgtaacccagcgggcctaaaatcagcagcgtaacggggacagtgaccagcagcgacagcatcggcgagagaaaaatacgcagcgcgccgggggagtagcggttgaagattttttccgtctgcgcataaaacagcacgcataaaatcgccgggaatacctgcgaggcataggcaacgttctgtaaatcaagcgataaaaaggtcgcgccttctgccagctgcttcgacatggcgggcagcaccatcaccgataccgccgacaccgccaccagcacgttaactttcagcttcatggcggtggtgatggcgacgagaatgggcaggaaatagagcggtgcggaaccgatgttatccagcactttataggtggatgagtcccgcgtcagccagcccatcagatccagcaacagcagcagcgacttgagcacgccgccgcccgcaatggccggcaccagcggctgaaaaacgctgatcacaaaatccactatctttgcgccacggctgactttatcggttgcggacggtgtggcctgttgcggcgcgcccacaagcgatcttaccgcatcgtaaacctgcacgacgtcgtggccgatgatcacctgacactgtacgttgacccgtatgcctaacacgccgggaatgctttccagcgcgggctgatccactctggcgttatcgtgcaggctgagccgtaaccgtgtggagcagtgctcaatatgggcaatgttttctgcgcccccaatgtgggcgatgatatccagagctgtctgtaagtggttcatatcaggcctcatttatttggcgcaaaaaaaaacctgaagccttcccccactgtgcagagagggaaggcttcaggtcttgcctacgtaacgtagtaacacgccttagccttttatatcgtcgcagaacgtactgaaagtcaaacatccaccgcgcgaacgatgcataactgtgagctgattaacaactcgccgcccttttgtgaacgggcgacgaggtgcagtttcagctttttttcgcgccgtagcgtgcaaaccaggtcagcatgcgctgccagccatcctgcgcggattcggcgtggtagctcgggcgataatcggcgttaaaggcatgcccggcatcgggataaaccacgatttccgccgtggcgttagccgcccgcagcgcctggcgcatggtatcgacagtgtcctgcggaatactggagtcctgcgcgccgtaaagaccaagcaccggggcggtgagttcggtggcaatatccaccggatgcgacggcgagttcatggttttatcccccaccagtttgccgtaccacgccaccgccgctttcagctgcggattgtgcgcggcatacagccaggcgatgcggccgccccagcaaaaaccggtcgccagcaggcggtgcggatcgccgccgttgcgcgcagcccagttggcgacgtgatccagatccgccagcacctgcgcgtccggcacctttgaaaccagttcgctgaacagggtcggaatatcgtcatacgcattcggatccccctgacggaaatagagctccggcgccacggcaagatagccttccttcgccaggcgacggcagagatcgcggatgtgctcatgcacgccaaaaatttcctggatgacaatcaccaccggcagcgcgccggcagcctctgccggacgggcgtggtaggcaggcatattgtctccccgcgaggggatggacgtcagacccgctacaataccgtcgtcagcagtcgtgatggcggtggaggcatggggcgaagcagcaggggcaaagccgggttgtttgtcagtggtcatggcgatctccgtacccttgtagtggtgcaaaaaagtagcgcaataaataactatagtcagccgtctaaaatacagcgctcatgaaagcggctatcttttgaggagtgcccggctgacgaacatgttaatgtgatgtatatcactattttatggaaaaccactgcaaacaattttattggcggtgatggttgtcacgaaatttaacgtgcagcttctgtaaagtacctttttgctacttctgacaaaccgatctacagaggagtcacctatgtcacagtctgatgtttttcacctcggcctcactaaaaacgatttacaaggggctacgcttgccatcgtccctggcgacccggagcgagtggaaaagatcgccgcgctgatggataagccggttaagctggcatcgcaccgcgaattcacctcctggcgcgctgaactggacggcaagccggtgatcgtgtgctccaccggtatcggcggcccgtccacctctatcgccgtggaagagctggcgcagctgggcattcgtactttcctgcgcgtcggcaccaccggggcgatccagccgcacattaacgtcggcgacgtgctggtgaccaccgcctctgtacgccttgacggcgccagcctgcactttgcgccgatggaatacccggccgtcgctgattttgcctgcaccacggcgctggtcgaggcggcgaagtccgtcggcgccaccacgcacatcggcgtgaccgcctcttctgacaccttctatccgggtcaggaacgttatgacaccttctctggccgcgtggtaaaacgctacaaaggttccatggaagagtggcagtccatgggcgtaatgaactacgaaatggaatccgccacgctgctgaccatgtgttcaagccagggcctgcgcgccggtatggtggcgggcgtgatcgttaaccgcacccagcaggagatcccgaacgcggaaaccatgaagcagaccgaaagtcacgcggtgaaaatcgttgtggaagcggcgcgtcgcctgctgtagttcgcgttttttacctccatttccagggccgatccattcggccctttctttttgcgtagcgcctcgcaggaaatcccttcccaggtggacatctgtacagcacaatcttactttgcaccggacagtgatttttgcaggggaagatgtggatatttcaatactgttaagcgtggcggcagcgctgctgggcggcgtcatgctgggatggctggccatgaaatcgcgcgccgatcagctgcgggccgatctgctcgaagatcgccgggaactggacatcgaattaagcgcggccagacaacagctggcgcagaaccagcactggcgcaacgagtgcgaactgctgaataacgaactgcgcagcctgcgggaaattaatacctcgctggaagccgatctgcgcgaagtcaccacccgtcttgaatccacccaactgcatgcggaagacaaaatccgccagatgatcaacagtgaacagcgcctcagcgagcagttcgaaaacctcgccaaccgcatttttgaacagagcaaccgccgggtggatgagcagaaccgccagagcctcggcagtttactgacgccgctgcgcgaacagctggacggttttcgtcgtcaggtacaggacagctttgggcaggaggcgcgcgagcggcacacgctggcgcacgagatccgcaatctccagcaactgaacgcgcagatggcgcaggaagcggtgaacctcacccgcgccctcaagggcgataacaaaacccagggcaactggggcgaagtggtgttaacccgtgtgctggaggcgtccggcttgcggcacggttatgagtacgaaacccaggtcagtatcgagaccgacgcgcgggcgcgtatgcagccggatgtgattgtccgtctgccgcagggtaaagacgtggtgattgacgccaaaatgacgctggtggcctacgagcgctattttaacgccgaagaagactatacccgcgaaaccgcgttgcaggagcacctcgcctcggtgcgcagccacattcgtctgctgggccgcaaggattatcagcaattgccggggctgcgttcgctggattacgtgctgatgtttatccccgtcgaaccggcgtttttgctggcgctggatcggcagccggagctgatcaacgaagcattgaaaaacaatatcatgctggtcagccccaccaccctgctggtggcgctgcgcaccattgctaatctctggcgctacgagcatcaaagccgcaacgcccagcagatcgccgaccgcgccagccgcctgtacgacaaaatgcgcctgtttgtggatgatatgtcgtccatcggccaggggctggataaagcgcaggataactaccgccaggcgatgaaaaaactcacctccgggcgcggcaatctgctggcgcaggccgaggcgtttcgcgggctgggggtggaggtcaaacgcgagattaatccggatttggttgaacaggccaccgcccaggacgaggagtttcgtttgcgtgccggtgagccggacgctgaagaatctcaggaagacaatgaattagctacgcgagccgcggtgaatgacagcccggagcgcgtatcgcaaggcggttgaaacatagggcaattgcgcccaatctgttacacttcacgaacaatttcttgataagcaggcactgagatggcggaagatcgacaagaaacttcacaggacacgacccactttggttatcagaccgtcgccaaaacgcagaaagctgacatggtggcgcacgtatttcattccgtggcggcaaaatacgatgtcatgaacgatctgatgtcctttggcatccatcgtttatggaagcgttttacgatcgattgcagcggcgtgcgccgtgggcagaaagtgctcgatctggcaggcggcaccggtgatctgacggcgaaattctcgcgtctggtgggtgaaaccgggcaagtggtgctggcagatattaacgactcgatgctgaaagtgggccgcgacaagctgcgtaatattggcgtcatcggcaacgttgaatatgtacaggcgaatgccgaagcgctgccgttcccggataacacctttgactgcattactatctcctttggtctgcgtaacgtgaccgataaagagaaagcgctgcgttcaatgttccgcgtgctgaagccgggcggtcgtctgctggtgctggaattctccaaaccggttatcgagccgctgagtaaagcctatgacgcctactcgttccatattctgccgcgcatcggcgaactggttgccagcgacgccggtagctatcgttatctggcagaatccattcgtatgcatcccaatcaggatacgctgaaggcgatgatgcaggacgcgggctttgaaaatgtcgattactacaatctgaccgccggtatcgttgccctgcatcgtggttataagttctgacaggagtctgccatgccctttaagcctttaatgaccgccgggatagagcgtgtgcttaatacgtttttataccgtcctcaggccctgaaacctgcacgccagcgcttacagggcaaggtgctgcgtattgtcgtcaaagagctttccacgccgctggtgctggcgttcagcgagcgtcagcttgatgtgctgggcgagtgggagggcgaagcagactgtacggtcattacccgactgcgcgtcctgccgaccctgcgcgatcgtaaacagctcacctcgcttatccgtagcggcgagctggaagtgcagggcgatttgcaggtggtgcaaaacttcggggcattaatggatctggccgagtttgacgcggcggagctgttagcgccctggaccggtgatattgccgctgaaggcatcagccaggcgctgcgcggcggcacggcctttgtacgcaagaattttcagcgccagcagcagtatgtcgctgaaaccctgaccgaggagtggcgtatggcacccggcgcgctggaagtggcctggttcgcagaagaaaccgcagctatcgcgcgttcggttgacgcgttaacccaccgtctggaaaaactggagggcaaatgacgcctggtgaaattcggcgcctttacttcatcatccaaacttttttgagttacgggcttgatgagctcatccccagaatgcgtcttaccatgccgcttcgcctctggcgccgcacgctgttctggatgccaaatcgccacaaagacaaggaattaggccatcgcctgcgtctggcattacaggaactgggcccggtatggattaaattcggacagatgctgtccacccgccgcgaccttttcccgccggtcattgccgaccagcttgccatgttgcaggaccgcgtggcgcctttcgatggcgcgctggctaagcgacaaatcgaaaaagcgatgggcggtattcctgttgaaacctggtttgatgattttgacatcaagccgctggcgtcggcgtctattgcgcaggtgcataccgcccggctgaaagagaacggcaaagaggtggtcatcaaagtgatccgcccggacattttgccggtcatcaaagccgatatgcgccttatctaccgccttgcccgctgggtgccgcgcttgctgccggatggtcgccgtttgcgtccgctggaagtggtgcatgaatacgaaaaaacgctgatcgacgagctgaatttactgcgcgaagccgctaacgccatccagctgcgccgcaatttcgaagacagcccgatgctctacgtgccggaaatttactccgactattgcagccaggacatgctggtgatggagcgtatttacggcatccccatcaacgacgtggcggcgctggagaaaaacggcaccaatctgaagttgctggcagagcgtggcgtacaggtgttctttactcaggtgttccgcgacagcttcttccatgcggatatgcatccgggcaatatttttgtcagctatgaacatccggaagatccgcagtatatcgggatcgactgcggcatcgtgggttcgctgaacaaagaagacaagcgctatctggccgagaactttatcgccttctttaaccgcgactaccgtaaagtggcggaattgcatgtggattcaggctgggtaccgccggacaccaacgtggaagagttcgagttcgctatccgcaccgtctgcgagcctatcttcgagaagccgctggcggagatctcctttggtcacgtgctgctgaatctgttcaataccgcgcgccgcttcaatatggaagtgcaaccgcagctggtgctgctgcaaaagacgctgctgtatgtggaaggggttggccgtcagctctatccgcagctcgatttatggaaaaccgcgaaacctttccttgaatcctggatcaaagatcaggtgggcattccggcgctgatccgttcgctgaaagaaaaagcgccgttctgggtggaaaaaatgccggaactgccggagctgatttacaacaatctgcgccagagtaagcagttgcagcacagcgtggagcaaatctcccgtgatctgcacgttaaccatatgcgtcaggggcaatcgcgctatttgttcggcattggggcaacgttgatactcagtggtacattattgctgattaaccgccctgattggcagtcggccccggcctggctgatggcgggcgggctggtcatctggctgattggctggcgtaagacgcgcgcaatttgatcgttcacaacgggccgcttaacgtatactgtggcccggtttattcatcatttatcactggggataaggtatgggtggtatcagtatttggcagttacttatcatcgccgtcatcgttgtgctgctgttcggcactaaaaaactcggttcgattggttcagatttaggcgcatcgatcaaaggcttcaaaaaagccatgagcgatgatgacaaacatgcaaaaccggcagaagacgcggattttacggcgaaatccattgctgaaaagccggatgatgtgaagaaagaagacgcgaagcgtcacgataaagagcaggtgtaattcgtgttcgatattggctttggtgaattagttctggttttcgttatcggcctcattgttctggggccgcaacgtctgccagtggcggttaaaacggtggcaggctgggtacgcgcgctgcgctcccttgcctctaccgtacaaaatgaacttgcccaggagcttaagcttcaggaatttcaggacagcctgaagaaagttgaaaaagccagtctggataatctgacgccggaactgaaagcctccatggatgaactgcgtgaagcggcggaatcgatgaagcgctcctacagcgctaacgatccggagaaagagagcgatgtcgcgcataccatccataatccgctggtaaaagataacgaagcgcagcatgaaggcattacgccagccacggcagaaaatcaggccagcgcgccggaacagaagccgtcgacggagcctgaagacaacgctgtccggccgaacgatgccgctgtcgtgaaaagccccgtacaggcagcgcctgcttccgattcaaccccttcaacgagtggtaaatcttaaacatggctgtagaagatacccaaccgctgatctcgcatctgattgaactgcgtaagcgtctgctgaacagcattatcgccgtgctgctgatttttctggcgctggtctattttgccaatgacatttatcaactggtgtcggccccgctgatcaagcagatgccggaaggcgccactatgatcgccaccgatgtggcatcgccgttctttacgccgatcaagctgacttttatggtgtcgctgatcctctctgcgccggttattctctatcaggtgtgggcatttgtggcgccggcgctgtaccggcatgaacgccgtctggtgatcccgctgctggtttccagttcgctgctgttttacatcgggatggcgttcgcctatttcgtggtcttcccgctggcgtttggcttcctgacgcataccgcgcccgttggcgtgcaggtttcaacagatattgccagctaccttgatttcgtcatggcgttgtttatggcctttggcgtgtcctttgaagtgccggtggctattgtgcttatctgctggatgggcgtgaccacgccggaagaactgcgcaagaaacgcccttatgtattagtgggggcgtttgtggtcgggatgctgctgacgccgccggatgttttctcgcagacgctgctggcgatcccgatgtattgcctgtttgaaatcggcgtatttttctcgcggttctacgtcggcaagcggcgtttccgcagcgacgaaagcgacgaagacgacagcgaaagcacaaaagagtaatcaatggccgcccgaaagggcggttgtcatatggaggacggcatgtttgatattggggtcaacctgaccagttcgcagttcgctacagacagcgatgaggtggtggcgcgggctttcgccgcgggcgttaaaggcatgctgctgaccggcaccagtctgcatgacagcgagcaggcacagcggctggctcagcgtcatgcgcattgctggtctacggcgggcgtgcatccccatgacagcagccagtgggatgcaaacaccgcagacgcggttttcgcgctggcccgtcagccggaagtggtggcgattggcgaatgcggcctggattttaaccgcaatttttccccggcagccgatcaggaagcggctttttccgcacagctggcgattgccgcagagctgtcgatgccggtatttttacactgtcgcgatgcccatgaacgttttctggcgctgctgacgccgtggctggataagctgccgggcgcggtgctgcactgttttaccggatcgcaggccgaggcggaggaatgtctggcgaaagggttatatctgggcatcaccggctgggtatgtgatgagcgtcgtggcgcggagctgtgcgccgtggtgccgcgtatcccggctgaccggctgctggtggagacggacgcgccttatctgctgccgcgcgatctcaaacccaaacccgcctcgcgacgcaatgagcctgcgtatctgggacatatagttgagcgcattgcggccctgcgcggtgaaacggcagaggcggtgagcaatgccacggatgcgaacgtaaagcagctgtttggcgtgacgttttaagccggatcggctttgcggaactcagtgttcttcacgctttgcagcacttgcttgttgaggaagttgagcagcagcatcgagcgcgcttcgccatccggctcggtaaagatggcctgcaggccggtaaaagcgccttcggtgatcaccacattgtcgcccgcgtatggcgtatcgggatcggtgatcccttccggctgacaggtggagagttgttcaatgaccgtgggcggcaccgtcgccgggctggcgccaaaacgcacaaaatggctgacgccgcgcgtggcgctgatggtcgtggtatgaatgatttccggatcaaactggacgaacagataattagggaaaagcggttcattgacgcgggtacgtttaccgcgcaccattttttccagctcgatcatcggcgtcagacagttgacggcctggcgttcaaggtgttcctgagcgcgctgaagctgtccccgtttgcaatacaataaataccaggcttgcatcatcatccttcccttgtgttcgggcgcaaggataccacaatcgcgttgttgattatatcgggtgcgggcgacgcgtttgcagtgagttttacgcttatttaacaaaattacagcatcacgcgggcgttcgccgtataataatccgcttacagagaggccatgattaactgcatgaaataccacgacctacgcgactttatggcgctgctcgaacagcagggcgaactcaaacgcatcacgtttccggttgacccccatctggagattaccgagatagccgaccgcaccctgcgtgccggtggcccggcgctgttattcgaaaatcccaaaggttactccatgcccgtgctgtgcaatttatttggcacaccgcgccgcgtggcgttaggtatggggcaggaagatgtcacggcgctgcgtgaagttggcaagctgctggcctttttaaaggagccggagccgccgaaagggtttcgcgatctgttcgataagctgccgcagtttaagcaggtgctcaacatgccgacgaaacgtctgcgtggcgcgccctgccagcaaaaagtggtgcagggcgatgccgtcgatctgacgaaaatccctatcatgcagtgctggccggatgacgccgcgccgctgatcacctgggggctgacggtcacccgtggtccgcacaaagagcggcagaacctcggcatctatcgccagcagttaatcggcaagaataaactcatcatgcgctggctgtcgcatcgcggcggcgcgctggattaccaggagtggtgcaacgcccgtcccggcgagcgcttcccggtggcagtggcgttgggcgctgacccggcgacgattttgggtgccgtaaccccggtgccggacacgctgtctgaatatgcctttgcgggtctgctgcgcgggacgaaaacggaagtggtgaagtgtatttccagcgatctggaagtgcccgccagcgcggaaatcgtccttgaaggctatattgaagcgggcgaaatggcgccggaagggccgtatggcgaccatacgggctattataacgaagtggataatttcccagtcttcacggtgacgcacattacgcagcgtgacgatgcgatttatcattccacttataccggccgtccgccggatgaaccggcggtgctgggcgtggcgctgaacgaagtgttcgtaccgatcctgcaaaagcagttcccggagatcgtcgatttttatctgccgccggaaggctgttcctatcgcctggcggtagtaacgattaaaaagcagtatgccggacatgccaagcgcgtgatgatgggcgtgtggtcattcctgcgccagtttatgtacaccaagtttgtgatcgtgtgcgatgacgacgtcaatgcccgcgactggaacgatgtgatttgggcgatcaccacccgtatggacccggccagggatacggtgctggtagagaacacgccgatagattatctggactttgcctcaccggtttccggtcttggttcaaaaatgggcctggatgccaccaacaaatggcccggcgaaacccagcgtgaatggggacgaccgattgttaaggatcctgcggtgacggcgcgtgtcgacgccatctgggatgaactggccatctttaatgacgagaacagacccgacagagggagcgcatgacaaccttaagctgtaaagtgacctcggtagatgctattaccgatacggtatatcgcgtccgtttagtgccggaagcagacttttccttccgcgcgggacagtatctgatggtcgtgatggacgagcgcgacaaacgccccttttcgatggcctccacgcctgatgagcgtgagtttattgaactgcacatcggcgcatctgaactcaacctctatgccatggcggtgatggatcgcatcctcaaagaaaatgagatcctgattgatatgcctcacggcgacgcctggctgcgcgatgacgaagagcgcccgctgattttgatcgccggcggcaccggcttctcctacgtgcgttccattctgctgacgtcgctttcgcgcaacgccaaccgcgatatcaccctgtactggggcgggcgcgaagagaagcacctttacgatctggccgagctggaagcgttatcggtgaatcacccgaatctgcgtattgaagcggtggttgagcagccggaagagaactggcgcgggcgcagcggcacggtgttaacggcggtgttgcaggatcacggtacgctggcgggacacgatatttatatcgccggacgcttcgagatggcgaaaatcgcccgcgacctgttctgtaacgaacgcggcgcgcgtgaagaccgtctgtttggcgatgcgttcgcgtttatttgatttttttccctcactccggccctctccccagggagagggtaaaagtaacgggaaattaccaataaaaaacccgcccctgacaggcgggaaaaacggcaactaaaacgtttttactttactcagactcgctcaaatactgtcgcgatgccctgacctaaaccgatacacatggtggccagaccgaactgcgcgtctttgcgttccatcagattcagcagcgtagtgctgatacgcgctccggaacagcccagcggatgccccagcgcgatcgcgccgccgttgaggttgatcttctcgtcgatctgctccatcagccccagatctttaatgcacggcaggatctgtgcggcaaaggcttcgttcatctcaaacagatcgatatcgctggcagtcagcccggcttttttcagcgccagttttgacgccggtaccgggccgtaacccataatcgacggatcgcagccaaccaccgccatggaacgaatacgggcacggggtttcaggcccagctcgcgggcgcggctttcgctcatcagcagcatggcggcagcgccgtcggacagggcggaagaggtgcccgccgtaaccgtaccgttcgccggatcaaaagccggtcggagagtggaaagcgcctccaccgtggtttccgggcggatcacttcgtcgtaattaaactgtttcagcacgccgtccgcatcgtggccgccggtcgggatgatttcatttttaaatgcgccggactgcgtggccgcccaggcacgggcgtgagagcgggcggcaaactgatcctgcatttcacggctgatgccatgcatacgggccagcatttcagcggttaagcccatcatgcccgctgctttcgccacgttacggctgaggcctgggtggaaatcgacgccgtgattcatcggcacatggcccatgtgctcaacgccgccaatcagacaggcctgcgcatcgccggtcatgatcatacgcgcagcgtcgtgcagcgcctgcattgacgaaccgcacaggcggttgacggtgttcgccggtaccgaatgcgggatctccgccagcagcgcggcgttacgggcgatgttaaaaccctgctccagcgtctgctgaacgcagccccagtaaatatcgtcaagcgcggcggcttccagctgcgcattacgcgacagcaggctgcgcatcaaatgggcggagagatcttccgcccgcacatggcggaatgcgcccccttttgaacggcccatcggggtacggatcgcatcaacaatgactacctgttccatcgtcactccttaagccgtgtgtgtttcaatcaccgggcgagcaggctcagccaggggataatagggttcgttatggcgcgctttttcatgcagtccttccggcacctgatagagcgggccgagatgctggtactgctgggccatatcgagatattttgcgctgccctgggtgtccagccagcggaatgcgccgccatggaacggcgggaagccaaggccgtacaccagcgccatatccgcttcggcggggctggcgataatgctttcttccagacaacgcaccacttcgttaaccatcggtatcatcatgcgggcgataatttcttcatcggagaaatcacgcttcggctgactgacgcccgccagcagttcatccactgcgctgtcttcttctttcttcggcttgcctttgctgtcttctttataacgccagaagccctgaccgtttttctgcccgaaacgaccggcgtcaaacagcgcgtcgatagcatcacggtaatctttctgcatacgctgcgggaagccttctgccatcactgcctgagcgtggtgggcggtatcaataccgacgacatccagcaggtacgccgggcccatcggccatccgaactgtttttccatcactttgtcgattttgcggaagtccgcgccgtcgcgcagtaactggctgaaaccggcaaagtaggggaacagcacgcggttgacgaaaaagcccgggcagtcgttaaccacaatcggggttttgcccattttgctcgcccaggccaccactttggcgatggtgctgtcggcggttttctcgccgcgaatgatctccaccagcggcatacggtgcaccgggttaaagaagtgcatcccgcagaagttttccgggcgttgcagcacgctggccagttcgctaatcggaatggtggaagtgttggacgccagtaccgtatccggacgcacgcggctttccgtttcggtgagcaccgcttttttcaccttcgggttttccaccaccgcttcgacaaccacatcaacgcgctcaaagccggcgtaatccagcgtcgggtggatagtcccgatcaccccggccagcttcaggccgtcaatttttccgcgctcaagctgtttattcagcagcttcgcggcttcgttcatgccgagggtgagggatttgtcgttgatatctttcatgatcaccggcacgcctttccaggcggactggtaagcgatgccgccgcccatgatgcctgcgcccagtacagcggcctgttgcggggcgtccgtgtctttggtgagttttttggcctggcctttgacgtactggtcgttaaggaagatgccgaccagcgcgcgggcttcgttagtgtgggccagcggtacgaagctctggttttccagcttcagcgcttcttcgcggccatatttcgccgcggcctcgatggtttttactgccgtgaggggggccggataatgttttccggcggtctgcatcaccatggctttggcgatggagaaactcatggcggcttcaattttgcttaatttaagcggttcgagcttcggctggcgtttggctttccagtccagatcgccattaatggcctgacgcaggatcgccaccgcgccgtcgcggagtttttccggcttcacgatgccatccaccaggccaattttcagtgcctgtgcggcatccacgtctttaccggcggcaataatttccagcgcgctgtctgcgcccagcaggcgcggcatacgcactgaaccgccaaagcccggcatgatgcccagtttggtttcgggcaggccaatgcgcagctccggggtggcgagacggtaatcggtcgccagcacgcattcacagccgccgccgagggcgtaaccgttcacggccgaaatggtcggcaccggcaaatcttccagacggttaaatacgctgttggcgaaatgcagccactggctgagctgttcctgcggcacctggaacagggaaaggaattcggtgatgtcggcgccgacaataaaggccgctttgtctgaacgcagcagcagcccttttaaatccgcttgtttttccaccacgccgagcgcctcgccgaggctggctacggttgccgtgtcgagcttgttgactgagcctggcgcgctgaacaccagttcggcaatgccgtcttccagccagtcgaggtacagggtatcgcctttgtagagcatgtcagtctcctgaatccagcatcattactggtcttaccagatgagacggagtgtggtttttatgttaataaattgcaaatgactctttaaaaagttgcagcgccgatcacgcttagcggaaatcacgcagcctttcgctcctgtgctaagatgcgaacaattcaggctaaaactagcgaagggaatatcatggaatcactggccgcactctataaaaatcatattgttacgttacaggaacgcacccgcgatgttctggcccgctttaagctggatgcgctgctcatccactccggcgagctgatgaatgtcttccttgacgaccatgcttatccgtttaaggtcaacccgcagttcaaggcgtgggtgccggttacgcaggtgcctaactgctggttgctggtggatggggtgaataaaccgaaactgtggttctatctgccggtggattactggcacaacgtggaaccgctgccggtgtccttctggaccgaagaaatcgacattatcgcgctgccgaaagccgacgatatcggcagccagctgcctgcggcgcggggcaatatcgcctatatcgggccggtcacggaacgtgctgccgcgcttgagatcaaagcggaacatatcaacccgaaaggggtgatcgactacctgcattattatcgcgcttataaaaccgactatgagctggcctgtatgcgtgaagcgcagaagaccgccgtgatgggccatcgcgccgcccatgaagccttccagtccgggatgagtgagttcgatattaacctcgcctatctgaccgccaccgggcatcgtgatatcgatgtgccctatggcaatattgtggcgctgaatgaacacgcgtctgtgctgcactatacgaagctggatcaccgtgcgccgtctgaaatgcgcagtttcctgttggatgctggcgcagaatacaacggttatgccgcggatcttacccgtacctgggctgcgaacagcgataccgattttgcccagctcatcaaagacgttaatgaagaacagctggcgctgatcggcaccatgaaagcgggcgtcaattatgtggagtaccacatccagttccatcagcgcatcgcgaaactgctgcgccgtcatcagatcgtcaccgatatgagcgaagaggcgatggtggaaaacgatctgacggggccgtttatgccgcacggtattggtcacccgctggggctgcaggtgcacgacgtcgccggatttatgcaggatgacacgggtacgcacatggctgcgccgtcgaaatatccttatctgcgctgtacgcgcgtgatgcagccgcgcatggtggtgaccattgagccagggatttactttattgagtctctgctggcaccgtggcgtgaaggggcgttcagcaagcacttcaactggcagaaaattgacgcgcttaaaccgttcggcggcatccgcattgaagataacgtggtgatccatgaaaacggcgtggaaaacatgacgcgggatctgaagctggcgtaatggaaagctggccgataccggcagagccggttaccgttacggaagagatcaaaaagagccgctttatcacgctgctggcgcataccgatggcgtggaggcggcaaaagcctttgttgagtcggtacgatcggcccacccggatgcacggcaccattgtgtcgcctgggtggctggcgcgccggacgattcgcagcaactgggtttctcggatgacggtgaaccgtcgggcacggccggcaaaccgatgctggcgcagctgatgggcagcggcgtcggcgaaatcaccgccgtggtggtgcgctactatggcggtgttttattagggacgggcgggctggtaaaagcctatggcggcggggtgcagcgtgcgctgaatcagcttacctccatccgcaaaatgccattaaccgcatatactttgagctgtgattacgcccagctggcgggtattgagtcgctgcttttacagttcgaaggaaagatcgtcgacagtcagtatcaggatctggtgcacctgcgggtagcgcttccgcacagcagactggatgaattttcggcaaagctggcggattttagccgtggttcattgcaattactggcgattgaagaataatccccacctcatttcttactacctaaggacgcggcagagatgcatttccgtgccataacccgaattgttggactgctggtcattttattttccgggaccatgatcctgcccggactggtcgctctcctttaccgtgacggtgcggggcgcgcatttacacaaaccttttttgtggcgctggcgattggttcgctgctgtggtggcccaaccgccgccagaagggcgaactgaaatcccgggaaggctttctgatcgtcgtgctgttctggacggtgctgggcagcgtgggggcattgccctttattttctctgaacgcccaaacctgacggtcaccgatgcgttttttgaatctttctccggtttaaccaccaccggggcgacgacgctggtggggctggacacgctaccgcatgccatcctgttctaccggcagatgctgcaatggttcggcggtatggggatcatcgtgctggcggtggccattctgcctatcctcggggtcggggggatgcagctctatcgcgcggaaatgcccggcccgctgaaagataacaaaatgcgcccgcgtattgccgaaacggcgaaaaccctgtggcttatctatgtcctgctgacggtggcctgtgcgctggcgttatggtttgccgggatgcccgcttttgatgctatcagccatagtttcgccaccatcgccattggcggtttctccacccatgacgccagcgtgggttacttcgacagtccgaccattaacaccattatcgctattttcctgctgatctccggctgtaactatggcctgcacttctctttattaagcggtcgcaacctgaaagtgtactcgcgcgatccggaattcaggatgtttatcggcgtgcaactgacgctggtgttcatctgtacgctggtgctgtggttccacgatgtgtacgactcggcggtcaccacccttaaccaggcttttttccaggtggtgtcgatggcgacgaccgccggatttactaccgacagcattgcgcgctggccgctgttcctgccggtgctgttactctgttcggcttttattggcggctgcgccgggtcaacggggggcgggctgaaagtgatccgtatcctgctactgtttaagcagggcaaccgtgaactgaagcgtctggtccacccgaatgcggtttacagcatcaagctggggaaccgagcgttaccggaacgtattctggaagcggtatgggggttcttctccgcatatgcgctggtgtttatcgtcagtatgctggccatcattgctaccggcgtggacgatttctctgcttttgcctccgtggtggcaacgctgaataacctcggcccggggctgggcgtggtggctgataactttgccagtatgaatcccatcgccaagtgggtactcatcgccaacatgctgtttggtcgtcttgaagtctttacgttgttggtgctcttcaccccaacgttctggcgtgaataaggaagcttttgtgaaaacgttaatattgttctccacccgggacgggcaaacgcgtgaaattgcctcttttatagcatcccagcttaatgagcttggcgtgcatgcggatgtggtgaatctgaatcgcgccgatgcgattaactgggctgaatatcatcgtgtcgtgattggggcatcaattcgctacggacattttcatccggcagtggaccgcttcgttaaaaagcacctgcaggagctgaacgcgcgaccgggtgctttcttctcggtgaacctggtggcgcgtaagccggagaagcgtacgccgcagaccaacagctatacccgcaagttcctgcttaactcgccatggcagccagaccagtgtgccgtgtttgcgggggcgcttcgttatccgcgttatggctggcttgatcgcgtcatgatccgtctgattatgaaaatgacgggcggtgaaacggataccagtaaagaagtggtgtataccgactgggataatgtcgccgctttcgcccgtgatatcgctcatttaacccacaaatcgtcgttaaatcaggcgtaacgcctggaaattgagcggttaaaaagttttttgcattttagacttgtcagcccggaataactccctataatgcgccaccactgacacggaacaacggcttacaggccaccgggtcagaaggtcttcctccgggaatgaccggcagagaaaagcaaaataatcgcttgactctgaatgaggaaaacgtattatacgggacctcgcgacacagcgccaaagcgcgtcgcaactgctctttaacaatttatcagacaatctgtgtgggcactcaaggacatggattcttaaacgtcgaaagacgctaaatgaataccaagtctctggagtgaacatacgtaattcattacgaagtttaattcacgagcatcaaacttaaattgaagagtttgatcatggctcagattgaacgctggcggcaggccta

SEQ ID NO: 7 - DNA, 50247 bp, Enterobacter sp SA187
taggcctgccgccagcgttcaatctgagccatgatcaaactcttcaatttaagtttgatgctcgtgaattaaacttcgtaatgaattacgtatgttcactccagagacttggtattcatttagcgtctttcgacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaggaagaccttctgacccggtggcctgtaagccgttgttccgtgtcagtggtggcgcattatagggagttattccgggctgacaagtctaaaattaaaaaaacttatcgatcgcacaatattcatacaaaacgagccagtgaagcgtattttcgcctggtttttaaacaaaaacgagccgcgcagggctcgttttcttcgttttgtgaattactgcacggcaactatttgctcatctttaaccaccagctggatggttttgccaggaataagctccccggacaagatttgctgtgccagcgggttctcaatctgctgctggatggcacgttttaatggccgcgccccataaaccggatcaaacccattggcgctgagcattttcagtgcctcatcggtgatatgcacatcatagccccgatcttccagacgctgatacagacgttgcagctggatcttcgcaatagaagcaatatggttttcaccgagcggatggaagaccaccacttcatcaatacggtttagaaattccggacggaagttctggctgaccacgcccagcaccacatccttcatatgactgtagtccagttcgccgaaacgctcctgaatcagatcggatcccaggttcgaggtcataatgactaccgtgttacggaagtcgaccgtccgcccctgtccgtctgtcaggcgtccgtcgtcaagtacctgcagtaagacgttgaacacatccggatgcgccttctcgatttcatccagcaggatgacagagtaaggacgacgacgaaccgcttcggttaagtaaccgccttcttcataaccgacatatcccggaggcgcgcccaccagacgtgataccgaatgtttctccataaactcggacatatcgatacgcaccatcgcgtcatcactgtcgaacataaagttagccagcgttttacagagttcggttttacccaccccggtcggcccgaggaacaagaacgaaccaatcgggcgattcggatctgataatccggcgcggctacgacgaatagcattagaaaccgcctcaacggcttcattctggccaatcacgcgaccgtgcagctcctgctccatacgcagtaatttgtcacgctcaccttccagcattctggctaccgggatgccggtccagcgcgccagcacttctgcgatttccgcatccgtgactttattacgcagcagacgcatggttttgccttctgactgtgtggcggcttcaagctgtttttcaagctcaggtattttaccgtactgaagttcagacatccgcgccagatcgccgacacgacgcgcctgttcaatggcgattttcgtctgctccagctccgatttaatggtctgcgtgccagaaagcgaggctttctccgctttccactcttcttccagttcagaatactgacgctctttgtcggacagctcatcattgagcatttccagacgttttttactcgcctcgtcagattctttcagcagcgcctgctgttccagcttcagctggataatacgccggtcgagacgatccagttcttcgggtttagagtcgatctgcatacggatgctggacgccgcttcatcgatcagatcgatggctttatccggcaactggcgatcggcaatatagcggtgtgacagggtcgccgcagcgacaatcgccgggtccgtgatctgcacatggtggtgcagctcatagcgctctttcagaccacgcaggatcgcaatggtgtcttcgacagaaggctcagcgacaaacactttctggaaacgacgctccagcgcggcatctttttcaatgtactgacggtattcatcaagcgtggtcgccccgacgcagtgcagttcaccgcgtgcgagcgccggtttcagcatgttcccggcatccatcgcgccgtcggctttacctgcgcccaccatggtgtgcagttcgtcaataaacaggatcacattaccttcctgtttagagagatcgttaagcacccctttcaggcgttcttcaaactcaccgcgatatttcgcgcccgctaccagcgaccccatatccagcgccagtacgcggcgacctttcagcccttccggcacttcaccattgacgatacgctgcgccagcccttcaacaatggcggttttaccgacgccaggttcaccgatcagcaccgggttgtttttggtacgacgttgtaacacctggatagtgcggcggatctcttcatcacggccgatcaccggatcgagcttgccctgttccgcccgttcggtcagatcgacagtaaattttttcagggcctgacgttggtcttctgccccctggtcattcacgctttcgcctccacgcatttgttcgattgcctgcgtcacattagcggtattcgcaccggcggctttcagtaagtctgccagcgtaccgcgcgactccagcgccgccagaacaaagagttctgaggaaataaaattgtcgccgcgcttttgcgccagtttgtcgcacaggttcagtacgcgaaccagatcctgcgacggctgcacatcgccgccggtgccttccacctgcggtaaacggcttaacgcctgctcaatagcggtgcgcagttggcccgcattgacgccagcagaggttaataaaggacgtaccgatcccccttcctgattcagcaaggcgctcataagatgaagaggttcgataaattgattgtcttgccccagcgccagagactgggcatcggcaagagcaagctggaacttattggtaagacgatccagacgcataactcctcccatagaaaacaggtcaaatttgctactggagattaaatgaggtcatccctcaattattcaaggttaatgacctgaataatatggaaagaaaatgacgcgcactggatcgtcttgattctttaggttatctcagccaaatgaaacttgccatacgcccggtggtcttgtcgcggcgatatgagtaaaattcgttcgtttctgtgaaggtgcaccggtcaccgccgaagatctgactaacgcctgcgcccgccagacgctgacgcgccagcagataaatattggcaagatacttttcatcgcgggcgacaaatgcggcgtccgcattcggatctactgccatgaaagcctcacggacttccggccccacttcaaacgcctgcggaccaatcgccgggccaagccaggccataatattgtccgggctatcgtcaaagcaggccagggtgttttcaagcacaccggcgcataaaccacgccagccagcatgagctgccgcgacttccgttcctgcacggttacagaacagtaccggcaggcaatccgctgtcatcacggcgcacacggttccgggcgtattgctgtatgacgcatcggcacgttttgaggcataaggcccgccgtccagacgctgcacctgatcaccgtgtacctgttccagccagaccggtttcgatggcaaaccgcccgcggcgaacatccgctgacgattttcctcgacgtgctccgggttatcaccgcaatgcgcacccaggttcagtgagtgccagggcgcgaggctcacgccgccgatgcgggtcgaactacaggccgccacgctctcaggctgcggccattgcgggataatcacgtgtgtcatagccagtctacgctgtccttatggatctggaagtcagcgcgcatggcctcgatcagatcgaccatgtcctgtgggataggcgcatgccattccatttcgatgccagtgatcgggtgataaagacgcagcatggtcgcgtgcagcgcctgacggtcaaactgacgcagcgcggcaataaattcatccgacgcgcctttcggcggacgcggacgaccaccgtacagctgatcgcccaccagcggatgggtaatgtgcgacatatgcacacggatctggtgtgtacgtccggtttccagacgcagacgcagacgcgtgtgcacacggaagtgttccataatgcgataatgcgtaaccgccggtttgcccatcggatgcacggacatatgcgtacgtttggtcgggtggcggctgataggctcttccactgtaccgcctgccgtcatatggccaatcgcgaccgcttcatattcacgggtgatctcgcgcagctgcagcgactccaccaggcgcgtttgcgcaggcacggtcttggcgaccaccatcaggccggtggtgtctttatccagacggtgcacgataccggcacggggaacatcagcaatcggcggatagtaatgcagcagcgcattcagtacggtgccatcagggttaccagcacccgggtgaaccaccagatcgcgcggcttattgatcaccagaatgtcatcatcttcatagacgatggtcagcggaatatcctgcggttcaaaacgcgcttcttcttcgatttcagcattgatggtgacgcgttcgccccccaatactttttcttttggtgtgctgcacaccttgccgttaatctcgacgcgctggtcaaggatccactcttttattcgcgatcgtgaataatcagggaacatttcggccaatgcctgatctaagcgttgaccgagttgattttcggacaccgttgcggtgagttgtactagttgtgccatagacagcttcttcgttaaccttgggtttttacggctttgccgtttaatatagtgtgctattgtagctggtcttaatcgggagcaggaacagagaatcctcccgcataaacattttgaggaaagtcaaaacgtcatgacgcgcatgaaatatctggtggcagccgccacgctgagcctggctttggtgggttgctccggttcaaaggaagaggtgcctgataatccgcctaatgaaatctacgcgactgctcagcaaaagttgcaggacggtaactggaaacaggcaataacgcaactggaagcgctggataaccgctatccgttcggcccgtattcccagcaagtacagctggatttgatctatgcgtactataaaaacgccgatctgccgctggctcaggccgcgattgaccgtttcatgcgtctgaacccgactcatccgaacattgactatgtcatgtacatgcgcggcctgactgatatggcgctggatgacagcgcattgcagggcttcttcggcgttgaccgtagcgaccgcgatccgcagcacgcgcgcgatgcctttaatgacttctcaaaactggtgcgtggctacccgaacagccagtatgtcacggatgccaccaaacgtctggtgttcctgaaagatcgcctcgcgaagtatgaatactccgtcgcgcaatactataccgatcgcggcgcatgggtggcggtggtaaaccgtgttgaaggcatgctgcgtgattatccggatacccaggcgacgcgtgacgcgttaccgctgatggaaaatgcataccgtaaactgcagctgaatgcgcaggcggacaaagtggcgaaaatcatcgccgccaacagcagcaatacctgattttcctccccaatgtaaaacggcagctcctgtgagctgccgtttttttatgcgttttacctgccgccggagcgggtttccgtgcaggccatccggtcaactatgccccctattatgagtatcaacaaggtaaaaattccgggttcacgttttaaatcacaaaaagctgtcgttgacaaaaagtgacgaaataatgtgattcaaatcacacattttgacactatgcaggttatgcttgttaataccaagacggaaagacaagaggtaacatctatgacaatgaacattaccagcaagcaaatggaaattactccggcaattcgccagcatgtcacagaccgtctcgccaaactggataaatggcaaacacacctgattaacccacatatcattctctctaaagagccgcagggctttaccgcggatgccaccatcaatacacctaacgggcatctggtcgccagtgcgaagcatgaagatatgtataccgcgattaacgacttgatcaacaagctggaacggcagctcaataaagtgcaacacaaaggtgaagcgcgtcgcgccaccacctcggtgaaagacgccaacttcgctgaagttgaagaagaagagtaatcctttacattgagtgtatcgccaacgcgccttcgggcgcgttttttattgacagggtgaaaacagtacggttactttactcagacacttgttcaggatcgcaccatgaaacttgttccgtttttcttcgcattcttttttaccttcccctgaccgggaggcgtttcgtcgtgtgataaagaatgcgaagacgaacaataaggcctcccacaccggggggccttttttattgataactataaaaaaggcaacactatgacaccggaaaacccgttactggatctgcgcataaagatcagcgctctggatgagcaattactgacgttactggcggaacgccgtctgcttgccgtggaagtgggtaaagcgaagctggcgtcccatcgtccggttcgcgatatcgatcgcgagcgcgatttgctggagcgcctgattacgcttggcaaagcgcagcatctggatgcgcattacattacccgcttgttccagctgatcattgaagattcagtgctgacccagcaggccctgcttcagcagcatctcaatcaaactaatccgcactcggcgcgcatcgcgtttcttggccccaaaggctcgtattcacaccttgcggcacgtcagtatgcggcccgccactttgaacagttcatcgaaagcggctgcgcaaagtttcacgacatctttaaccaggtggaaacgggccaggcggattacgcggtggtgcccattgaaaacaccagctcgggggctatcaacgatgtctacgatctgttgcagcacaccagcttatccatagtggcggaaatgacggtgcctattgaccactgcgtgctggtttccggccccaccagcctggatcagatccagacggtctacagccatccgcaacccttccagcagtgcagccagtttttgaatcgctatccgcactggaaaattgagtattgcgaaagcacctcggcagccatggagcgcgtggcgcaggcacagtcgccgcatgtagcggcgctgggcagtgaagcgggtggcgggctgtatggattgcaggtgctggagcgtaacctcgcgaaccagacgcaaaacattacgcgttttgtcgtgctggcccgtaaagcggtgaaagtatccgatcaggtgccggcgaaaaccacgctgctcattgccactggccagcaggcgggcgcgctggtagaggccctgctggtcctgcgtaatcacaatctgatcatgaccaagctggaatcccgtccgatttacggcaacccgtgggaagagatgttttatctggatattcaggccaacgtcgaatccgccgccatgcaaaaagccctgcacgaactgagcgagatcacccgctcaatgaaagtgctgggctgttatccgggggaaaacgttgtgccggtcgatccggcttaacgttccacgaaaagggactttttcacccctgccacctgcaccggcagggtgaaaatggcgcccgacagcggatattgcgccgtttcttccggggtcatgttttcccttgtagtggtaataaacagcgttttcatgtccgcgccgccgaaacagaccatcgtcgggcagcgtaccggcaggcgatattcttccagttgctcgccctgcggcgagaagcgcgcgatgcgccagccatcatagagcgcgctccagtagccgccttccacgtccaccgccgcgccatccggcattccctctccgtcagtaaagcgacgcagcaccttacgctgcccaggctcgccgtcggcgtcgagcggcgtgcagtaaatcaccttctccggcgtgtccgaggtgagcatccacttgccgtcaggactgaaggccagcccgttcgcgcccttgatgtcgcactggatcactttcggggtcagatcgttatcgatacgcatcagctgcgcgccgttataatcccccggcgcccagaaggtcccggcgtagaaacgcccgcgcggatcggtgccgccgtcgttgaaacgcgccagttgcggattggacggattgtcgcagactttattggtcagcagcccgcgcttatcggcgagccatatcgcagtgcgcatggcgacaataaaaccgcccttctcgcgtagcgcaaaacagcccacttcctccggaaagcgcagcacagaatgctcgcccgaggcgagatggtaacgatgaatttcgccttcaataatatcggcccagtaaagcgcctgctccgcctcactccaggtcgggcattccggcagatggccggtataatcaaacagcggttgcggttcagccataacaaatcccttcttataaaaaaagccagcggatcacccactggcttcaagtatatgcagcttttcagttattgacggctgtcgttcgcctggcgcagcaatacgcggctttcgctctggaaacgctcagcgtaatcgccgaaccagtgttccaccttacggaagctgtcgatgaaggcctgcttgttgccctgctccagcaggccaatcgcctcgccaaagcgctggtaatagcgtttgatcagcgccagattactttccgacgacataataatgtcggcatacagctgtggatcctgggcaaacagccttccgaccatcgccagttccagccggtaaatcggcgacgagagcgccagcaactgttcaagctgaacgttttcttccgccagatgcaggccataggcaaaggtggcgaagtggcgcagcgcctgaataaacgccatgtgctgatcgtgctccacggcgctgatgcggtgcagccgcgcgccccagacctggatctgctccaggaaccactgatacgcttccggctggcggccatcacagtacaccaccacctgcttggcgaggctgccgctgtccgggccgaacattgggtgcagacccagcaccgggccgttatgcgctgtcagcatcgcctgcaatggcccgctttttaccgacgccagatcaaccagaatgcagtcatccggcaatggcggcagtttagcgatgatcgactccgtcacgtgaataggcacgctgacaatcaccatacctgcgtccgccacaatggatgcagcgcgcgaccagtcctctttttccagaatgcgcacttcatagccggaaagctggagcattttctcaaacagccgccccatctgcccgccaccgccgacgatcaccaccgggcgcagcgtcggatgcagcgtcttaaagcctttgtcgttttcgctggaataggattcgcgcattacccggcgcaatacatcttcaatcagatccggcggcacgcccagcgcctgcgcttctttccggcgcgatgccagcattgaggcttcgcgctccggcacgtaaatcggcaaaccgtatttgctttttacttcgcccacttcggcgaccagcgccaggcggcgcgccagcagatccagcagcgccttatccacttcatcaatttgatcgcgcaacgcggtcaattctgcaaccatgacaacctcttaagcgtgacgcgtcgccagatgcgcgcgcaggtccttatcgatctcgcgcagcagcgcatcggtcgtttcccagctgatgcaggcatcggtaacggaaacgccatacttcatttcgctgcgcggctgctcggatgactgattgccttcgtgaatattactttcaatcatcagaccaataatcgaacggttgccatctttaatctgtgcgacaacagactctgcaaccgcaggctggcgacggtaatctttgttggaattaccatggctgcaatctaccatcagcgacggcttcagtcccgcctgcgtcatctctttttcacactgcgccacgtctgccggactgtagtttggcgctttgccgccgcgcaggatcacatgcccgtccggattgccctgcgtctgtaacaggcaaacctgtcccgcctgattgatccccacaaaacggtgcggcatggctgcggcgcgcatggcgttaattgccgtcgccaggctgccatcggtgccatttttaaagcccaccggcatggataaaccggaggccatttcgcggtgcgtttgtgattcggtggtacgcgcgccaatcgccgaccagctgaacagatcgcccaggtattgcgggctattcggatccagcgcttcggtcgccagcggcaggcccatacccaccagttctaccagcagacgacgcgcaatcttcaggcccgcttccacatcaaaagagccatccatatgcggatcgttaatcagccccttccagccaacggtggtacggggtttttcaaaatagacgcgcatcaccagatagaggctatcgctgacctctgcggcaagggctttaaaccgacgcgcgtattcaatggccgcttccggatcgtgaatggagcacggaccgcaaaccaccagcagacgcggatcgcgcccggcaataatgtcagacagcgtctgacgggattgctcgatttgcgcctgttgttccgccgtcagcgggaattccgctttcagctgatcgggcgtgattaatacgtgttcgtcggtaatatgtacgttgttcagcgcgtctttttgcatgatggcgatcctgtctggctcgtttgcgatagtgtctcgttgtgagagtgatttaacgataccacaaacggtaaacatttcaatccaaaatacgtacaccttactttacaatatgcattttaaggccatttaaatgcttttaacgtgtaaagataacaatacacagcagcatgtgccgttattcgggctacgcttacataacacacaggagaacgtaatgaagacaggtatggttttgcttttacccattttattgatcggctgctccgtagaaccttacagccatgccccgacctggaccggtacggactggtacagcgccggtaaagacgatgccctgtccggcgcggtcataaagaataatgagacgctggcgctcgagcacaacagcaaagaaattaaccgtccccggtacgcagagggttacgcggatggcctgaaaaagatctgtcaggatgattttctgtatgcctggggccgcgccgggaaaatttacccggcgggctgtgacacgcttgaaaatgccagcacttatcgtgcgcactggcaaaaaggcatggaagaaggcgcacgcgacagccggcttaattaagctatccgcgtgcggtgtttactccgcgacgggtcgccgggcgcaggctttgcgccagcgcagcacgtccaccgccagaaacagcagcaggctgacgcccagcaccggtaatgccagcgccagcagcagcgccaccacgctgaccacaatacgtcctgccacgggcagcgccagccagctttgcatcaatgtctgtaccgggctgacgttcgacccggcaggcctgcgcagccaccagagccggtaacccatcacaatcatcacgcacagtccaaggccaaaggcgatcagcaccagttgattgggcagcccgaacagcacgcccatatggaaatccacgccccaacgggtcagtttcgccatcaacgggaaatcctcaaaccgggtgctgtcgatcacctgcatagtatttgcgtccaccgccacggcatccacctgggtcggccagctacggtcgatttcggtgaccgtccaggcgctgttggcatcccgcggcgggcggatctcaagcttcgccgcattgatgccagccgcacgcgcgacctgcaatacttcatcaaactgtaccgagtcctcaacgctggcaggcatctccatgccatgatgatgaccatgatgttccgcatggggatcggctgcctgcgccgggccgtgcaactgggtgttcacctgcggcgtcatccagccgaaggcagcgcgcattttgtcaacgttcccgcccgcccactgggaccatgtcagcccggtgacggaaaacagcagcatgcccgccagcaggatccagccgagggtgacgtgtacccgccgggtattctggaagctgttgttcaggcggcgcttcgggcgcgtataaaaccacagcactatgccgccaagcgctgcggcccacatccaggacgccgccagttcactgtacagccgcccggtatcgccaagcagcagcgagcgatgcgcgtagtcaatgatttgccgcaacggcaggatgccgctggtgccatagacggtgtgatcccctttcaccgccagcgttaccggatcgataaaaatcgcccggtgctccgacacgccgagcgccggatcggcaaacattacgcgggtagtgtccgtatccgcgagtcccggacgcacggcatgcagacgcagatggccgccggtaacctgttccgccaccgcgatctgttccgccagcggctgacgttcgccggtagtggtaccgtaaagcgtatcggcataaaacaggttttccagctgtggggtggcaacgtacagcgtcccggtcagggccgccacaaagatgaacggcccgacaaacagaccaatataaaaatgcaggcgtcgcagcaggtttaaccaggccgcgcgcggggtgcaggtagtcatacttttccttactgaaagcaaaggttcgccttgtgcgcaggcacaggcttaatgggttttaacaggaaaaagcagactggcgcggcggcgcgcgggtttgaggataaagccagggaataaaacgccatgcccgttcgggcgggggaagcggtgcgatataaatacgggtaagcgtagcggagagaaaaagcaccgccagcaggatcaggccgggcacgtgcgccagcagtacgcaatagccgcaggcttcggcatgatcgaccggaataacgtccggcgcgctgtcgtggtgttcagccatcatgctcatgtcatgatgcatgcccggcatgctcgccatgggatctttttgcaggctgacagagataagcggcgcgaccaggatcagcaaaatagcaaacagggcgagccatgctgctttacgcttgatgctggtatgatgaaatgcgctctgtgtcacgactcctccgcatgcagggggtcattgtaaacgatttattggtttttggttaatctggcgggcaggttttgggcatgcggggaataaaaaaagggccgacccggaggtcagcccttttctgatgggatgtcgcgaaagcgatatcttagttaagacgctctttgatacgagcagacttaccagtgcgctcacgcaggtagtacagtttagctttacgtacagcaccacgacgtttaacagcaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgttttttggaaccttcaacaacccatactttcacttccacggtgtcacccggacggaaggaaggtacgtcctgcttcatctgctcttgttcaagttgcttaataatgttgctcataatttaatctcttatcctgggtaaactgatatttgggggcttacgcctgcccatcatgtttatgctgctgttgtgcgtgctcttttttgaactccgccagcaactttgcttgctcttcagtcagagccaggttttccagaagttcaggtcttctaagccaggtacggcccaacgactgtttcagacgccagcgacgtatctcggcatggttccccgacagcaatactgccggtacttccatcccttccaacacttcaggacgggtatagtgcggacagtccagcaatccatcggcaaaggaatcttcagttgccgaggcttcatgtcccagtacccccggaataaaccgggaaaccgagtcaatcagcgtcattgcgggtaactctccaccgctgagaacgtaatcgccgacagaccattcttcgtcaatctcggttttgattacgcgctcatctatcccttcgtagcggccacacaccagaatcagcttctgatgcgttgccagctcgctgacgcccgcttgatcaagcttgcgtccctgaggtgacagataaatcacctttgcgccttcacccgccgcggctttcgctgcgtggatggcgtcccgcaagggttgtaccatcatcagcatccccggtccgccgccgtaaggacgttcgtccacggtacggtgccggtcatgagcgaaatcacgcggactccagctctggatgctcagcaggccattttttacagcccggccagttaccccgtaatcagtaatcgcacggaacatttcaggaaacaggctaacgataccaataaacacgcgccaatccccttagcaccgacttttactatttatccggaggttttaaaaaccaggatcccaatctacttcaatggtgcgagtagtgagatcgacattcttgataacctgcccatcgaggaacggaaccaaccgctccttgataccaaatgcatctttcaggtttgccttgatgacgagaacgtcattggagccggtttccatcatatcaatgactttacccagcccgtacccttcggtggtcactacctggcagccaataaggtctttccagtagtagtcgccatcggtgagggccggcaactgcgaggtatctaccataatttcgcaattagtcagtagattcgcgctgtcacgatcgtcaacgcctttcagcttgatgatcagatcctgattgtggtgcttccagctttccagctgtacctgctcccactgacccgccttctggataaaccagggctgatagtcaaaaatgctttcggcgtcttcggtggaggaaaacactctgagccaaccacgaataccgtaggaagaacccattttgcccagtacaaccggttcaacagggacttttgcggcgagttgcttgctcatcatgaccaccgtgacagattaagctgctttttttgcttctttgatcagcgcagatacgcgatcagagatagttgcgccctggccaacccagtgagcgatgcgatccagatccaggcgggtgccttcttctttttcgctggcgatcgggttgaagaaaccaacgcgctcaatgaagcgaccgttacgtgcgttacggctgtcagtaacaacaacctggtagaacggacgctttttagcgccgtgacgtgctaaacgaatagttaccataacatcctcttgtgtgaataaaacaccgggccccctcggagggacggagcccggtgttatattaaaagcccgaaaattttactgatttctgggggaaatgcaatcaagatatagcaaaggggagatttaaggccgtcggcggtgcaggcagtttgacgtcggcgtgcgcggagtcgccggagcgtacacgtagtacgtgacggtgacgagcacaccccggtgtcaaaatggcaaacaagccaggccgggatatttatcgacccgggaatcctgggggcatcatccctttcatgcctctcatcattttcgccatcccgcccttcttcatcttcttcatcatgcgctgcatgtcgtcgaactgcttcagcaggcggttaacgtcctgcacctgcatgccgcaaccggcggcgatgcggcgcttgcgggaacctttaatgatttccggcttagcacgctctttcagcgtcattgagttaatgatcgcctccatacgcaccagcactttatcgtccatctgcgatttaacgttgtccgggatctgccccatgcccggcagcttgcccatcaggcttgccataccgcccatgtttttcatctggcgcagctgctccaggaagtcggtcagatcgaagccgtcgccttttttcagtttggtcgccagcttttcagcctgcgcgcggtcaactttgctttcgatatcttcgatcagcgacagcacgtcgcccatgccgagaatacgggacgcgatacggtccggatggaacggctccagcgcttcggttttctcgccgacgccgaggaacttgatcggcttaccggtaatatgacgaatggagagcgccgcaccgccgcgggcatcgccgtccactttggtcagcaccacgccggtcagcggcagcgcttcgttgaaggctttggcggtattcgccgcatcctgaccggtcatcgcatcgacgacaaacagcgtttccaccggcttgatcgcggcgtgaacctgtttgatttcgtccatcatcgcttcgtcaacgtgcagacgaccggcggtatccaccagcagcacgtcgtagaacttcagcttcgcttctttcagcgccgcattaacgatttccagcggtttctgggcaacgtcggacgggaagaaatcgacgcctacctgctgcgccagggtttccagctgtttgatcgccgccgggcgatacacgtccgccgacactaccagtactttctttttatgcttctcgcgcaggaatttacccagcttaccgacgctggtggttttacccgcaccctgtaaacccgccatcagcaccacggctggcggctgcgcggccaggttaagcacctggttttcttcacccatcgccgcaaccagttcgccgcgtacgattttgatgaactcctggcccggggtcaggcttttattcacatcctggccaaccgatttttctttaacccggttgatgaaatcgcgcacaaccggcagggcaacgtccgcctcgagcagcgccatgcgcacttcgcggagcgtttctttgatgttttcttcggtgaggcgtccacggccactgatgttgcgcaacgtgcgcgacaaacgatcggttaaattatcaaacattgtctctcgcctgagtcagaaacgttggccgcatgaagcgacacatacatacgattttgccgcagtataacatgaagccttctttcgccatattgcagcgcgacatgttatgccagctcacctcagctatccgctaaacggcccgataagcgccgtttagcggtgacttcactccacttttccagccagacggaccttaatctgcttatagtaatagtcattattaatgatgtatttacgcatcaacagggtaaccaacaggttaaaaatggccgggatgatggtcatcaatagcgcaatgcccatcaatgattgtgctgactgagtctgtccgggttgataatcaaagctgctcagcatcagtccgacaaagccccctgccagccccataccaaacttctggaagaataagatgccgccaaacgcgaggccggaaacccgcacaccgcttttaagttcaccgtaatcaaccgcttccgcaatcgccgcccagtagaccggcaattgcatatcgccgagcagactcagtaaaaaataaaagacaaatgccagccagatgtcatcttgtccgacgacaaaatacatcgcgacaccgaaagcaaaagtcagaaactgggtaatgcgaaacatcttaattttatcgtaacggttagtgatataagtggcgaaaaagatagcaatgcctgacgccacgacgcccatggtcagaaaggacgcaataagatcttcgccaccattaagataatatttcgcataataggcagaaacggaactgcggataatgccgccgaacataataatggcaatcgcaaggccaaggattaaccactggtcgtttttaaataaatggctaatttgctgtttaaaaataaagggctttaccggatgaacaatccgctctttcaccgtagcaaaacagaacagacaaagcagcgtggcggcaacggccatcacccccattgtcagtttatagcctcttgccaggtcattcccccctaaataaacggccagaatgggaacggcactggctacgaccagcaccgccgttttgttcatcacaaaccggaatccgttagcggtaagtcgctcctgtggatcgtcagtaatcacaccgatgagcgaaatataaggaatggagatcagggtataggcaagcgttaacagaatataagtaaagaatgcccatgccagctttccggcgtaagtataatccggtgtagaaaacatcatccagatcgtcagaccaaacggaatggagaaaaagagcagataggggcgataacgcccccagcgtgtttttgttctgtcggtaataatacctactaacggatcgcttattgcgtcaacaaaccgcacgacaataagtaaaatgccgacgtggctcgccttgagtccataaacatcggtataaaaataggtgacgatcatggccatggatcccatcaccaggccaatagccgtatcgccagcgccgtagccaaccttttcgctgaaagagagtttcatattattatctcgtcaatttgttgtgtcagatctattttttagtgattttctgccgtcgcaaaaagtgctccagggcttgccgcaattcgcgcgtcaacaggctgcattgtcagtggcggcgtgggtaatttttgataccagtacagggtggaggaaagagggttggcgtgaccatgctgcagggtgacgagaatacgttttttaaaatgaatcggatcggtgagatggaagcgatagcgggtctggatacctgcaacatgagagtcgtgtaacgacgagccgcaaaataagctttcccgatcctgtatcccccacgcctgactgaaataatcttccattcccgtcccctggatcctgcgctccagcgggggatcatcatcaataaatatcatctcatccccttcaccccactctgtgccctgccagtgacgtaccgagagattacagccgatataatgtccctcaccttcaatatctaaaagccggtaatgatactctgcactggtacagggaatattcacttccgggctgttgtcctgcaattccggtgcccagccacggcaggggtttccccgcttccaccatgcatggaagtaagccacatccgccgggtgtttatccggataacattcaaaatcgatattaaagaactgcccgtagggaatatcgttttgattttccacttcaataatcgcccgttcattaaaaggcatcggcaggtaacagttaaaggcggcgctgccgccattgcgataacgctcttccgggcggacggtaacggtaaagggcagcgaattgaaaccggcggagattgaatgaccgaggcaaaaaaaatcgcctaatggcgcgatcacggagggctgcgtctgattatcccagtatatttttaacagcaccttgcgataataatcggcatcatgttcttcccagctaaccccgagagcattattgatttcgttaatcgccccaacatattgcccggcgactggatcaattaacgcggcgcctttaagacggcgacaaaactgggtcatccagatatgcgtaatgcacccactgccctggatgtccgccagccgaatagtttcgccaggtggaatgatccagtaatcctgattacgtccactttgatcccaactggataacctcccgctacgggcgtttcttatccgacaaataccctgcaaaaatcctgacgtttgcgcagtcataactcacctttactatatttatcaaaaataataaaaggcgttaaaacggatcaatcatcttcccggaccactcaacgcctggaggaaaacccatgctaactcgagagagcaaattaaccagtcattatatagctggcaaattgtttcacgatggaatgtgattacactcaccaaaaaaggcttatatttaatcagtgaatatatttaaaggccattacggtatccctggtgccgcatgcaaagtctgatgcaacggttggagccagcgacacgtaacgttatactccctcttctgtcttgcttactgtcgacaccactatgcccgtttttgctctgctcgctcttgtcgcctattccatcagcctggcgctgattattcccggtttgctgcaaaaaaacagtggatggcggcgcatggctatcgtctcagccgtcgttgcattagtcagtcacgccgttgcgcttgaagcacgcatttttccggcgggcgaaggcggccagaatttaagcctgctgaacgtcggctcgctggtcagcctgatgatttgcacggtaatgaccattgtcgcctcaaagaatcgtggctggttgctgctgcccatcgtctacgcctttgcgctgatcaatctggcatttgccattttcgtacctaacgaatacatcacccatctggaaaccacccccggcatgatggtgcatatcggcctgtcgctgttctcctacgcgacgctgatcattgccgccatgtacgcgctgcaactggcgtggatcgattatcaactgaagaacaaacgcctcgccttcagcagtgaaatgccgccgctgatgagtattgagcgtaaaatgttccatatcacgcagattggcgtggtgctgctgaccctgaccctgtgcaccgggctgttctatatgcacaacctgttcagcatggaaaatattgataaagccgtgctgtcgattatcgcctggttcctctatatcgtgctgctgtggggccattatcatgaaggctggcgcggacgtccggtcgtctggtttaacgtcgcgggcgcaggtctgctgacgctggcctatttcggcagccgcgtgttacagcagctggcaggctaacgaaacaaaggattttcccctggaacatatatcaaccaccaccctcatcatcacgctgatcatcatggtgatcgtttcggcgtacttctccggctctgaaaccggcatgatgacgctgaaccgctaccgcctgcgccacctggcgaagcaaggcaaccgcgcggctaagcgcgtcgaaaagctgttgcgtaagccagaccgcctaatcagcctggtgctgatcggcaataacctcgtcaacattcttgcctctgccatcggcaccatcgtcggtatgcgcctgtacggtaatgccggggtcgccatcgccaccggtgtcttaaccttcgtggtgctggtgtttgcagaagtactgccaaagaccatcgccgcgctctatccggaaaaagtcgccttcccgagcagtttcctgctcggcccgctgcaaatcatcatgatgccgctggtgtggctgctaaatatggtgacgcgtctgctgatgcggatggttggcattaaagcggatgtggtggtgagcggcgcgctcagcaaagacgaactgcgcaccattgtgaacgaatcgcgctcgcaaatttcccgccgcaatcaggatatgctgctgtcggtgctggatctggaaaaagtcagcgtcaacgacattatggtgccgcgcaatgaaatcgtcggtatcgacatcaacgatgactggaaatcgattgtgcgtcagctgacgcactccccgcacggtcgcatcgtgctgtggcgggattcgccggacaacgccatcagcatgctgcgcgtgcgcgaagcttatcgtctgatgaccgagaaaaacgagtttaccaaagaagtaatgctgcgtgcggcggatgaaatttactatatccccgaagggacgccgctgagcattcagctggtgaaattccagcgcaataaaaagaaagtcggcctggtggtcaatgagtatggcgatattcagggtctgctgaccgtggaagacattctggaagagatcgtcggcgacttcaccacttccatgtcaccgacgctggcagaagaagtgacgccgcagaacgacggctcggtgatcatcgacggcaccgccaacgtgcgtgaaatcaacaaagcgtttaactggcacttaccggaagaagaagcgcgtaccgtcaacggcatgctgctggaagcgctggaagagatcccggccaccggcacgcgggtgcggatcgggcagtatgatattgatattctggatgtgcaggaaaatatgattaagcaggtgcaggtgatcccggtgaaaccgctgcgggacagcgtcggggaataaactggccgggtgaggcgttagccgccacccggcactaaaacccccgcttaagctttcgctttagcgacggtaaccatcgccgcgcgcagcgtacgaccgttcagcgtatagcctttttgcatcacgcccagcacgttaccggcagccacctcatcggattccaccatggcaatggcctgatgcacgttgggatccagcggcacgttagtatccgccacgacgcccacaccgaatttacccaccacatccagcatcgatttcatggtcagctcaataccttcgaccatcggcgccagatccgggttggatttatcggctacctcaagggcacgatccaggctgtcaaccaccggcagcagttcgttgataaacttctccagcgcaaatttatgcgccttctcaacgtccagctcagtacggcggcgcaggttttccatttccgctttgatacgcagcacgctctcgcgctcgcgattttgcgcttcggctaattgcgcttcgaggttcgcaatctgttcatcgcgcggatccacctgctcaacagaagcgtctgactctgtcgcctcgacctcttcgtgctgttccgtgataatttcttccggggcttgcccctcaggcgttttctgttctttactgctcatgaatttctccgcgtttttttgcattcatctcgctaacttcgcttattatggggatatgtttccgggtttcaagggaagcagcgagattgtcatcatcatccggcacaaggatctccagaatatgaataatcatttcaagtgtattggtattgtgggacatccccgccaccctaccgccctgaccacacatgaaatgctctatcgctggctgtgcggtaatggctacgatgtcattgtagagcaacagattgcccaggaacttcgtctcaaaaatgtgaagacgggcacacttgccgaaattggtcagcaggcggatctggcggtggtggtaggcggcgacggcaatatgctgggagcggcgcgtacgctggcccgctatgacatcagcgtcatcggcatcaaccgtggcaacctgggtttcttaaccgatctcgatccggacaatgctcagcagcagctggctgacgtattagaaggccattacatcgcggaaaaacgttttttgctggaagcgcaggtctgtcagcaggactgccagaagcgcatcagcaccgccattaacgaagtggtgctgcaccctggcaaagtggcgcacatgattgaatttgaagtctacatcgacgaagtgtttgccttttcacagcgctcggacggcctgatcatttccacgcccaccggctcgaccgcctactcgctctcggcgggcggccccattctgacgccgcagctggacgccattacgctggtgccgatgttcccgcatacgctctcggccaggccgctggtgatcaacagcagcagcaccattcgcctgcgcttctcgcaccgccgcagcgatctggaaataagctgcgacagccagatcgctctgccgattcaggagggtgaggacgtgctgatccgccgctgtgactatcacctgaatctgatccatccgaaagattataactatttcaatacattaagttccaagctcgggtggtcaaaaaaattgttttaatttcagcgccagggctttactggatataaaaccagtttatactgtacgaaaacacagttatggtttttcatacaggaaagcagctatgttggcacaactgaccatcagcaactttgcaatcgtacgtgagcttgaaattgattttcacagcgggatgaccgccatcaccggggaaaccggtgccggtaagtctattgctattgatgcgctcggtctgtgcctcggcggtcgcgccgacgctgacatggtgcgcaccgacgcctcgcgcgccgatctctgcgcccgcttctcccttaaagacactcctgccgcgctgcgctggctcgaagctaatcagcttgaagacggacgtgagtgtttacttcgtcgcgtgatcagcagcgatggacgttcccgtggctttattaacggtacggccgttcccctctcgcaactgcgcgagctgggacaactgctcatccagatccatggccagcacgcccatcagcagttaatcaaacctgaacatcagaaatccctgctcgatggctatgccggtgagtcggtgctgatgcagcagatggcggaacattaccgtcagtggaatctgagctgccgcgaactggcgcagcatcagcagctcagccaggagcgcagcgcgcgcgctgaactgctgcactatcagttgaaagagctgaatgaatttaacccgcagacgggcgaattcgagcagatcgacgaagagtacaaacgtctggctaacagcggtcagttgctcagcaccagccagagtgcgcttaacctgctggcggacgatgatgacgccaacctgcaaagccagctgtataccgcgcgccagctggtgacagagctggcgggtatggacacgaaactttctggcgtactcgatatgctggaagaggctgccattcagatcagcgaagccagcgaagagctgcgtcattactgcgatcgcctcgatctcgatccaaaccgtctttttgagctggaacagcgcatcgcgaagtatatttcgctggcgcgtaagcatcacatcagcccggaagagctgtcacagttccatcagaatctgctggacgaacagcaactgctggacgatcaggccgactcgcaggaaaccctgtcgctggcggtgcaaaaacaccatcaacaggcgctggctaccgcgcagcaactgcatgccgaacgcgtgaagtatgcgcaggagctgggtgggttaatcactgaaagtatgcactcactttcgatgccgcacggcgtgtttaacatcgacgtcagtttcgatgaccgtcatttaacccaggaaggcgcggatcgtattgagttccgggtgaccactaacccgggtcagccgttgcagccgatttcaaaagtggcctccggtggtgagctttcgcgtatcgcgctggccatccaggtgatcaccgcccgtaaaatggaaaccccggcgctgattttcgatgaagtggatgtggggatcagcggcccgaccgcggcggtggttggcaaactgctgcgccagctgggcgaatccacgcaggtaatgtgcgtcacccacctgccgcaggtggcgggttgcgggcatcaccacttctatgtcagtaaagagacggacggcgccatgaccgaaacgcacatgcagccgctggacaaacgcgcccgtctgcaggagctggcgcgtctgctgggtggcagcgaagttacccgtaatacgctggcaaacgccaaagagctgctggcggcctaaactttttcagcaattcagagtcatagtgaaacattaaatcgccgtaagaccggatactgctacacatacaccttcaggcagccaacgatgaggcagcctgaaggatgaagtgtatacacaaaagcattcaggttgcatcaaggcggcaagcgaacgaatccccgggagcatagttcactatgtgactggggtgagtgaacgcagccaacgacgaggcagcctgaaggatgaagtgtaattacacaaaagcattcaggttgcatcaaggcggcaagcgaacgaatccccgggagcatagttcactatgtgactggggtgagtgaacgcagccaacgacgaggcagcctgaaggatgaagtgtataaaggttttaatgtgactaaaggtctattatcatcggcatattaccaatgagccgcgtactgctctggcccgaaaaggaatgaaatcactatgcgctgtaaaacgctgactgctgccgcagcggttcttctgatgttgaccgcaggttgttccactctggagcgagtggtgtaccgtcctgatattaatcagggcaactacctggcacctaacgacgtatcaaaaatccgtatcggtatgacgcaacaacaggttgcttacgcgctcggcacgccgatggtgaccgatccgttcggtactaacacctggttctacgtcttccgtcagcaacccggccatgaagatgtgacgcagcagaccctgacgctgacctttaacagcaacggcgttctgaccaacatcgataacaagcctgccctgacttcgcagtaagggtacagaaaaacaaaaaggtgctcatgagcacctttttttatggcctgcgaaacccttacttctctttgtccgcgcttttttctgcccgcttgcgacgcagctctttcggatcggcgatcagcgggcggtaaatctcaacgcgatcgccatcgtgcagctcgtcggccagcttcaccgggcggctgaaaataccgactttgtttccggtcagcgaaatatccggccgcagttccagcagcccggaggcgcggattgcctcttcaacggttgcgccctcgttcagcgtaacccgttgcagatactgcttttccggcagcgcataggccacttctaccaccatcttacccggcactgtaaacctctttggcgcgatgggtaaaggcctgcaccatgttcatcgccagctctttaaagatgcggccaaacgccagttcaatgagtttattggtgaattcaaaatcaagctgaaactcgacgcggcaggcctcggggctgagcggggtaaacttccagccgcccatcagctttttgaaagggccatcgaccaggtgcatcaaaatgctttgattgctggtcaatgtattgcgtgtggtaaacgttttactgatgcccgctttcgaaacatccacggcggcggtcatctgcgtcggaccggactccagcacgcggctaccggtgcagccgggcaagaactccggataggacttcacgtcgtttactaactgatacatctgttctgcgctgtaaggcactaacgcagatcggctaatctgaggcatagcgttttcctgggatctacaccctataaataataacatctccctcccaggaaaggaaaacgcttagccgcaactcgtgctaatataacgcgttacacctcgcaggacggaatggggtgtttttataacatcagattacctatactgagcggcattatgaccaagaaaaaagcacacaaacctggctcagccaccatcgcgctcaacaagcgcgcccgccatgaatattttatcgaagatgaatttgaagcgggtctggccctgcagggctgggaagttaaatcgctgcgcgccggcaaagccaatatcagcgacagctatgtcatcctgatcgatggcgaagctttcctgtttggcgccaactttacgccgatggccgtcgcctccacccatgtggtctgcgatcccacccgtacccgtaaactgctgctgaaccagcgcgagctggatacgctgtatggccgcatcaaccgcgatggttatacggtggtggcgctgtcactttactggaagaacgcctggtgcaaagtgaaaatcggcgtggcgaaaggtaagaagcagcacgacaagcgtaacgatgtgaaagataaagagtgggcggtggataaagcccgcattatgaaacacgcgggccgttaaatccgtgcgtctcccctcaccccggccctgatttgccgggaggggggcgaaattaccgctcccgcaatgcctcgttgaccttgttcagcggcttgatcagataatccattaccgttttctgtccggtcttgatctccacgttcgccaccatacccggtaaaatcgggaagcttttgccgctcttgttatgcagctcggcttttgaggtgcgcacatacacccggtaataaaactgatcccgcttcacctcatcctgcaacgtatccggcgataccacttccaccttgccgcttaaatccccgtaaattgacgaatcataggccgtcacctttacggtagccggtaagcccggacggatataggcaatatcccgcggattgatgcgcgtctcaactaacagctgatcttctaacggcacgatctccatcagcttgccgcccggttgcagcacgccgccgacggtggtcacctgaatgtctttcacgatgccgcgcaccggcgaaaacagcgaggcgcgatccacctggtccgctttaccggacattacctggatctgcgcgtccagatcggcattgtttttcacctgctcctcgcgggcgcgcaccgcaaactggttacgggcatcgtcgattttgccctgcaactcggcggcctgccgttgcaggcggatcacctccacctggctcgccgcccctttggccaccagcggctgcgtcagacgcagctccgacatcaccagctgataggttttttgcagattcgctaccgtctcattgaggtttcgccgccgcgactcatacagctgccgctcacgggccaccaggtccggctcgcgcattgactcggcgctaaagcgcagcggctcgccggtcagttcggaacgcagacgctcgctggaggcgcgcagcgtgcgcacccgtgacgccgcctcgccgtagttcgactgaaaacgggtaggatcgaggcgcgccagcagctgcccgcgttcgacaatatccccctctttcaccagcaggccgctgacaatgccgccgtcgaggctgtcgatcacctgcgcgtggctggagggggtgatcttgccggtgccgaccgtcacttcatccagcaccgcccaccaggcccagacgacaaaaaacagcagaccgatcagcgtcagccagatcaccgaggagtaaaagcggccctggcgcgccagatcgtcctgcatacttaattgactcatggcgttctccttatgcgactgacgagacgctgctgttgcgcaccgcctgcttgatcagcgtatcgcgcggcccgtcggcaacgattttgccgttctccattaccacaatgcggtccaccagattgagcagcgccggacggtgcgtcaccagtaccagcgtgcgcccggtcagccactgggagagctggcggatcacccaggcctccagttgctcatccatcgacgcggtgggctcatccatcagcacaatctgcggattgcgcacgatcaggcggcttaacagcaccatctgccgctgcccgccggacagcccgcgcccgccctcgttaattaacctgtcgaggctggcggcatcctgctgcaccatgccgatcgccccgctgatgcgcagcgcctggatcagctccgcttcggtggcgtggggatggccgagcatcaggttttgtcgcagcgtgccaaaaaacagccgcgaatcctgggaaaggtaccccagctggcgacgtacatcgccaggatcgatatgcgccatatccacgccatcaatgatcactttgcccttactggcctgcgcctgaccggagagcagtttcagcagggtggattttccggcgccggttttgccgaggatcgccacgcgctcgccgggcttgatcgtaagttccgggatctgcaccgcctgctcgcccttttccacatcgtagctgtactgcacctgctgcatctggaaatggcctgccagcaccgggcagtgcgccattttttcccccgcggttttatccagcggttttttcagcagatcgttcaggccgttcatcgccgttttggcgtgctgccagcgggagaacaccatagtgagctgcatcagcggcgcgatggtacgcgacgacagcaaactacaggccaccagcgtcccggtggtgatactgccttccatcaccagatagcagccgaacaccagcatcccggcgtaggtaatttgctgcacggtggaggcccatccgctgagccgcgcgccccatacgcgctgcttcatgccgatccccgcgcctaccgcatgagtgtgttcccactggcgctggaaatagggttccgcctggagcgctttgatgtcttccaccccttcgatggactctaccagcaccgcgttacgaatggcgctttcgcgcatcccctctttggccagtttcgccattggccactgcaccaggatgccggggatcacgatcagcggaatagcgatcagcgggatcgccaccagcgggccgcccaccagcgtcataatgccgaggaacagcagcacgaacggaatgtccatcgccgcgccgacggtggtggaggtcagcagctcgcgcacctgatcgatttcacgcagctgggaaataaacgaaccggtggatttcggacgggcatcgtttttgatcgccagcgcgcgggcaaaaaacagcgacgagacgttgagatcgatatgcttacccataatgtccgacacatgggtacgggcgagacgaataaaaaactccagcagggcggcgaacagcacgccgataaacagcacccacagcgtggggatcgactgggccgggatcacccggtcgtacacctgcatagagaataaaatccccgccagcgccagcacgttgccgagcagtgaggcgagcgcgatctccgacagcttgcgtccgctgtggcgaaagtgccgccagaaccagtgcgcttcccagggtttggtgaaatcatcaatgcgcgcatcgcggccacgggcggcaatgcccagcatcaccacctccggcctgacgcgggtgagcagcgtttccagcggctcttcgcgcaccagatcgcccccttccgacaaccagtaggtcgccagcccgtcggcgtcaatagactccagcagcatcaactccccggactccagctggacgatcaccggcaggttttgcgcgttccagcgcatacgctccagcggcaccgtgcgcacctgtagccccatcaggccgcttaagcgctccagccgggcgctctgcggcagcgcttcaaaccagcgcatttgctggcgcaccgcgggggcatcggcaggcaggccgaatcgacccgccgcgcgcaccatgacattgatccagctttcggtatcaggctcttgcattactgctccttaaagtgaaggcagggtatcgccaatagtgcggctgcgttcaatgcccagcatatccagcagattatctgcggcgccggcataacggacggcggcgtcccaggcgtcatagcgcgcagtgatcgaggccgtgtctgcctgaaagacatcctgttcaatactcagaagatcgttgaggctgcgcttgctgagacgatactcatcgcggtacacctcgcgggcgcgatcggcgctgataaactgcgcgtcccctgcccgctggcgctgctgcgccccggtgagatccgcccaggcggtggcggcgcgctgattcatctccagtttgctggcctccacctgggcgcgggcgttggcgcggtcgccttctgccgcatccacccgcgcgctgaccgcaccgccctgatagaggggcgcgtccacgacaagctgcacctgatcatcccagtagctgctgttttcgttctgataacgggttcgtcccgcctgtaccgacaccgtcggccagtgctgggcctgcacctgacggatgcgctgttccgccgccagctgtttcgactgggcgctgcgcacggcattgctgcgctcgtacggcagcgatttgagggtaattttttgtttcatcagatcgtcaggcagatccggcagcgtatccgacaccacgccggtcagcacgctcagggcagcctgcgcggagcgggtctgggcttcgtactgtgcgagcgtggcgttcagcccggcgatgcgcgtctgcgcctgtaagacgtcagactgcgagctcagcccggcctgggcgcgcagatccgccatctcctgcaccgccttcagtgaggcgatatttttacgcgccgcgtccgccagcgcctgatgacgcttaacctgcaagtaagtttgcagcgtctccatgccgacttcattaagcgcattgtagagatcgtaacggtaggcatccgacagctcatgctgctcgtcaatgctgccgccggttttaccaaagtcgtaaatcagctgttttaagctgacgccccccgcgccattactgctcagcgagcccgccgaatcggtacggtgcgaacgtccgacgttcccctgtaaagacacctgtggaaaccatgcgctttccgcttcggaaagattggcttttcccacctggatttgcgccgccgcctgagcaatttttggattgcgggcgaaggcgcgcaaaatagcctctttgatggtcagctgcgcctggaattgctcgccgggcgcggtctgccactgatactcctcagcccaggctggcagtatcgctgttccgggcactgccagcagcaacagccctatcgtcgctaatttcatgatcccacctttggctgcccgtggtgatattttacgttccctcgcctcgtccctgaggctgcgatccggtcatcagaccatattgacgtgcagaccctgctgcaccagtacatcgcctaaggtgttgctttgtgaactgttgtggtagatgtcgaactgcataccatccacctcccgctggccgctgatcgcccagatgtcgctgttgccatgcaccagattcacgctgtcgcctttactccccttgatgatcaggtcatcttccggtttatcggtcaccgtcagcgcctcgttcagatccagcgtgatgctgttggtgcccgatttgcccagatcgatgatctcgatattgtgcacacgggtggcggcgtcgatcaggttaagtaccagatccacgccgtcgagcaccagggtatcggtgcctgccccgccgtcgatctccacaaagcccagggtcgcaaggtgaatggtgtcattgccctcgctgccctgcacgctatcgccgctggcttcggtgccgtccgccagggtgatgctgacgcctccaatagtgtaggccgcctcctccgtctggttgagcgtactatcactttcggtagtggcagccgtcgcggtagcgcgtgcggtcagggtgctggccggtgcgctgtcagtctcctgtacggtgttgatactgtctgaatgcagcacgaagctggagtcatccgtcgccagcgccatcagagtggcaggcggcgtggtggagatgatattcccgcccaggccgacgttcagatagccggtgttgccagcggcatcggtggcgtacaggttaaccacgctggtgagcgacaacaggttcaggatgttcagaccgaggctcagtgtggtggaccagttgccgttggcgtccgttatcgcggtggtgcttaccgtgccgttgagcagcgacagatgcaccacggcatttgcccccagattgcgcgaaccgccgcttaacgttaaccctttggtcagcagcgtcagcgggttcagggttgccagcgggttccaggtcagctccggcgtggtaagtttgacggtcacatccgtgctggtgctgttggtgttgccgactttatcaatgaccgacacacccactttcagcgcgccaccggtcaaccctttcagcaccgtgctgctgaccggtaacgaccagctgccgtccgggttcacggtggcgttataactggtgccgcccagcgacaccaccacgcgcgagccgtcggtgatgccaccgttaatgcgcccggaaatggtctgcgtaccgttcgactccgccacgttcaggaagccatcgttgccgaacagcgaggtcagcgaaatagacggcaggctgtgggtgatcacgttcagcagcccgctggtgcccgcgacgttgcccgccgggttggtaagcgaggcgttaaccgacaaggtgccgtcgagcaacgcgctgagatcggctttcggcaccgagaccgaccagttgccgtcggatcccaccagcgcctggtaaaccttgttgccgagcgtcacgttcaccagcgagccgaccgcattggtcgccgagccggtaatggtctgggcgctgagaatatccgtcgcgttcagaccaccgtcgccaaacagtgagttgatcaccagcgtcggcgcctgctggatggctaccagcagatttttggtatcggtggcgacgttacccgccacatcccgcgcggtgacgcccacggataacgtaccgtccgtcagcccctgcagggtggcggtcggcagcggtaaacgccaggagccatcactgccgacggtggtgttgaaggtcaggccgccgagggtgacagtcagggcagtgcctgccgccaggttagtggtggtaccgttaagcacctgcgcgcccagcagatccgagaggctcagattcccgtcgccgaacggcgtattgaggctgacagaaggcagcgcgttgatcacggcgttaatcagttgcgagctggagccagggtttccaacatcatcacgcacgctggcgctaacggtgacgttaccgtccgccagtccctgcaatacagatggcggaacgttcaccgaccaggtaccgttgttgatggtgcccgtcagcgtggcagtgccgacgcgcacggtcaccgtgccgctggcgagactggtgacgccgctgatgatctggcctgcatccgcttccgcccggctcagataaccgtcgccgccaaacagcgtgcctgtgttgacgctcaccgtcggcagaccggtcagccccactttgatggccgggccattggtggtggtggtattgccgtccggcgtctgaatggtgatcacaggcgtcagcacgccgtccgccagcgaagctaaatccgccgggctgacattaatgctgaaggtaccgttacccgccagcacaccggcgaaggttttggtaccgatctgcacgctcaccgtggaaccgaccggggcctgcgcgacgctaccggtaatggtctgcgtcagcagcgcatcggcggcgttcagcagcccgtcgccaaacagggtgacggcattcagcaccggcgcgagcagatccagcgccacgtttgcgcccacggccgcattgttaccgtactgatccgtcgcctgcacgcttaccgccacgttgccggtgcccagcccctgaagcgctgcctgcaccgcctccggcagggcaacggaccatttcccgttgccgtccacattggtcgtgaatgcagtggtatcgccgactttgatgctcagggtgcggccattcagcccggtcgccgtaccgctgatcaccccgcttaacagttccggaatgctcagcataccgtcgccaaacagcggatcgagcacaatagaaggctgtgcttttaccgccaccgtcagatcggtactgccattcactacgttgccgaatttatccgttacgctgaccgcaaggcctacggtaccgtccggcagcgcgccgagtaacgatggcggcagcgtggcgatccagttccccagcgcatcctgcgttccctgaatggtacgtccggcaatggtgaccaccacgcccgcgacgttggccgcattattcagccccagcgacaccacctggctggtggtactgtcgaccaggttgatgatgttatctgccgccaccgtaatatcgccgatcaccggcagatcggtcagcgccgtgccgacgttgatgatctgattagtggagttaccgtaaatatcggtgacatccacctgcaattgcagggtttgctgcgtcagcccggtccacagatcgggcggcaactggatgctgaatttgccatcggcgcccaccgtggtggtcgggatagtggcgctcaccccggcgatggtcactttcaccgtcgcgccgcgataatcgccgcttacttgcccggtcaccagctgcgtgatcagcgattccgccacgttcagcacgccatcgatgccaaagacatcgttgaccacaacgccaaggccctggttgagggcgacgttcagcccgacattgttactggacgtattacccgccgcgtcggtggaggtgatgttaatcacctgagccccgtcggtcagcgtgcgcagctccagttccgggaaggtatggctccagttaccgttactgtcgaccgtactgctccagctgagcggcccgagcgtcactgttacagtgttccccggctcgccgcgtcccgccaccagcataccggtggcggcttccacggtattcagcaccgccggcacgctgagcgcgttgacctccagcagcggctcatcgcgttgcacgctgatgatcctgccgtccaccgccgggttgcctgcgacatcgcttagctgcgccgtcaccggcgtactgcccgacggcagcgcggcgacatccgcctgcggcaccaccgttgaccagttgccgtccgatcctacaaccgcatagtaagtcttgccgttgagggtcaccgacaccgtgcgcccggcttccgacaggctggcagtaccgcccagcgtcaatggctgaccgctttcggcggcgttaataatatcgtcaccggacaccggattcagggtcagcgtcggggcgagcgtatccacctgcaccaccaccgaggaggtggagttcggcgcagcctgactggtggcttcaatggtatagctcgtctggtccgggaaggcgctgaccggcacgctggtcgtccaggtgttgttgccgtccaccgttgccgttcccaccagcacgccatttacggtgatgttaagcagcgtacctgccgggtacccattgctctggccgttgaccgtgatcgcaggcccggcgctgaactcgctggcgttgataatgttatcgcccgccaccgggttgaccgtcacgctgaaggctggcggtacggtatcaatggtgacgcccaccggcccggtggtggccgggttgcctgcgatatcctgcaccgttgcctcaagggtcgtactgccgttggcgagcgtcgccatctgcaacggagtgagctgtagcgcccaggtattgcccggctgtacggtggtggtaaaggtctgtccccccagcgtcacggtgatggtgcgccccacctccacattgctggtggtaccggtgagggtttgcagctgctggctttccgtccagtcgagatcgctgttgccgaacggcgcgttcactgaaatggtcggctggttaagggcgatcaccaccggcgtgctggtgctgccggtattccgggcatcgtcagtgatggtgacgatcacgctctgctgaccgcgatcgacaccgatccagctgtcgctgtccagcgccagcgtccaggtattggtcagcggatcgacggtggcgtcaaagattttgccgccgatggtgacctgtaccgtggtggccgccggatcccttgaagtaaaggtgcctgacaggctggccggcgcggtggattcgctgatgttgagataattatcgccaaagatcggcgtgttcaccgtcacggtcggcgcggtaaaggcgacgtcaaatggcacctgggcggtctgcacgttaccgtactgatcttcggcacgcacgacgatagtgtgcgccgtcgccggatccagcccctgcagggtgccagccggcagcgacaccgtccactgccccgcgggatcgacatcagccacataggtgacgccgtcaacatcaatggtcacggtgacaaactgattgccgccgctcagacccgtgctgccggtcagcgtcagcgggcctgccgcctcgctgatattcagcgtctcatcgccgccgaacaggttagtcacgcccggtgtcggcaatgccagctgcggcacaaaggtctgggtggcggaatccacgttgccataggcatcgctcaccgtcaccaccacggtctgcgtctggccgttggttaagccggttaacgccgacggcggcagggtaacgctccactggccgtttgcatccacagtcgcgccggtattgtaaggcacgccgttcagggtgacggtgaccgtctgccctgcaccaatgaccccggtgttgccggtcagcacctggcctgcagccgcttccgaattattcagcacgccatcggtaaagagcgtgcccagcgtcacctccggcacattattgatcacggcctggaagttaccgtcgccgttcacgatattgcccgccgtatcggtgacgatgattttcaccggaatggtgccgtccggcaatgtgcccagcgtcccggcgctgactggcagggtccactcgccgttcgcgcctatattcgcgtcggtgatggtgataaagggaccgttattaatactgacctggatggtctgaatactggctttatccagcccggtggtgccggtgagcgtactgtctgccacttcactgctgatcagcacgccattaccgaaggccgtatccagcgtcggcgtcggcagcacacccgcgcggacgtcaaagtcctgagccgggctggtgtcgctgttgccggctttatccgttacggtcaccgccagggagtaagcgccgtcgctcagcccggttaagaccgtcgatggcagctgtaccgtccagttaccgttattatccacggcgccgttaaccgtgatcggatcggtcaggccattgccggtaatggtgatcgccacggtctgcccgccgccggtgaggccggtggtgccggtaaggatctgcccggtgctggcttccagctgattgatgatgccgtcagtaaagagcgtcgcaggcagcgtcgcatccggggccgcgcgcaccacttcgatccccagattgccgctggccgggttagcataggcatcggcggcgctggcagtaatggtgtacggaccgttagcaaactggttaaaggtgcccggcgcgatggtcgccgtccagttgccatcactgccaaccgaggcagtaccaatctgcacggtaccaataaacagcgtgatcgtcgccccggcaggcaaccccgttgaggtaccggtgatctgccccacatcggtcgcttctgcggtgtttatcatgccatcggtcagcatcagcgtattgccgatggtgatggcaggcagcgtcgtgttgcccacattaatcggcagcggcgtgctggaaacgttgccgtccggatccgtggcggtaagggtcagcgtggacgggccctgcggcagcgcctgcaactcctctgccggaatgacaatgctccattgacccagctgatcggcccgggtttcgacaggggtaccgttgatcgtcagcgatacgatggagcctggcgtggtggtgccgctcagggtctgggcgacggcggattcactgatgttaaccagcccatcggacaggaagctgggatccagattgatgtccggcccgacggtatcgacacgcacctgctgcgtgctggttgccgggttgctggccgcatcgctggcggtggcggtgaccgtataagtctgatccgccagcccgctgaccacgctggcgggcacctgcaccgaccatctgccgtccgcgccaatgctggcggtatagctgcctccgcccggcgccagcgtcaccgtcaccagtgtgccctgcgccagattggtggagacgccggtaatggcaactgcgccgctgctttccggatcgctgataacgttatcccccgccacgctgtcgatactgagcgtcggctggctgcctggctgggtgataaaggtaacgttctgcgtggcgtcgtcgacgttgcccgccgcatcggtgacggtcacgcggatcggctgcacgccgtcctgcaccgccgccaggtcagtcgccggaacagccacgctccagctgccgtcggcctgcacggtggccggatagtcaacgccattcagcgtaacggtaacgatctgcccctgttccacattcaccgtcgagccggacaccaccagcggcgaaccggcttcgctggcattaacatagttatccgttgagatactgttcatggtgacctgcggcgcattcaccggcgaggcgtcgagggtaaagctctctttgatggtggcactgttccctgcgctgtcagtcgcgatgaccgtcatgcttaccgggccatccgggatgccgctcagcgccccggcaggcagcgtcacgctccagtcgccgttggcctggatcagggcattataggtctggccgttaatctgcacgacgacggtttgcggctgcgccggatcgtaaggcgtggcggtgccggtcagcactatcggtcctgccgcttcggcggcattcaccgtgccgtcgcccgccacatcgcccagggtgagtaccggcggcgttttgtccaccaggatgctgctttccagcaccgccgcgttacccacgccatccgtagcggtgatcaccaccggcacggtgccgtcggttaaactgttcagcaaggtggaagggacgttcaccgaccagttgccgctggcatcgacggtggccgtcagcgtctgcgcctgagcgccggagccgatctgtacctgtaccagctgacctgcgccgctgacgccggtcgtaccgctcagcgtgccgcccgtcagcgcctcgctgctgttcacaataccgtcggtaaagggctgattcatggagacggtcggcagggtggtggtgacaatagtgaactgatgactgttactcacgacatcgccgctgccgtcctgggccgatacggtgagggtggcggtgccatcgctgatggcgcgcgcctcctctgccgggacggtcacgctccacgccccgcctgcgccaacggcgcccgcgtatagcttgccgttcagcgtcaccgtgatcggcgttccttccgccagtccgacggagctgccgctgaccaccaggccactggcgttattaatatcgctgaggctcacccgatcgtcgccggtgagcggcgcaatggagatcgcgctgacagtggtgtcaacggtaaacggacgggtggcgctggtgctgttacccgccgtatcgctgacctgtacgctcagcgcatagtcaccgtcaagcagaccggccagttcgcccggcggaatagtgacctgccagctgccatcggcgcccacggtgccggtccagctggagccgccctgggtgacggtcaccgtctggcctgcttcaacgttcagcactttaccggtcagggtgatggcttcgccgcgttcggcggcgtcaatcacgttatccccggcgaccggatccacggtaagcagcggctgtttctgcggatcgatgcgcacgctgatgttatggctggcggtggtgctgttttgcgccgcatccgtcacggtaacggtaaaggtcgcctgcccgtccggcagcgcctgtagcgccgaagacggaatatcgacagaccatacgccgttcgcgcctgtcgtggtggtgtaagtctggccgttaagcacaacggtgaccggctggtctgcgcccgcgccgctggcgacgccggagagcgtctgggtcgcgcccgcttccgccaggttaagcgtgtcgttagtggcaaaaggatcaaaactcagcaccggcggttcaacatcaatgttgacgttgatcggcgtgctggtggcggtgttaccggcaatatcagtcaccgttaccgtcaccggcagcggcgaatcggtattggttaagctgtccagcgcgccggacggaatggtcacgctccactgcccgttctcattggccgtgccggtaaaggtattaccgccaagattcacgctgaccgtctgccccggcccggtgacgccggtttccccggtcagggtctggttctgctgaatttccgcgccgttcagcacaccatcgccaaacagcgggtcagtgtttgcctgcggcagcgcattgaggatgagattaaccgtatgggtatcgctcaccgtcacgccgttaaccacggcggtcgccgtgatggtcagcgggccatccgccgagccggacagcgtgcccggggccagcgtaatgctccagttgccgttagcatcgacaaaaccaggataggtcacgccgttcacctgcacctgcacctcggtgttgagcggcagaccggcgctggtgccgttgatggtcaccacgcccgctgcttcctgcacgccaatatagtcattgccggagatgatgctgatcgccaccgccgtcggggcgctgtccaccgtcaccggatagatgctgttcgttgtctggccgtaaatatcggtgacgctgatctgcaccgggttttcccccggcgtcagctgatagagcgtgccggacgggatcagtaccgtccagctaccgtcgctggccaccacagactggtacgtattaccgcccagcgtcaccactacccggctgcccgactcggcatcggtcgtggtaccgcgcagtaactggtcagttttgatttctgccgcgtccagcccgttattaccggcaaaggaggtgacggtggcggtcggcggcgtggttttgacgttgatggtctgctcaataacgtgtgggttaccggcggcgtccgtcagggtgacagtcgctaaattcgcgccgtccgccagttgccgtcgctgcccaccgttgtggtgtaggttttattgttcagcaccacggtaaccggacgcccggcttcctccaccgatgagataccgctcagcacctgtgcagtattcatatcttcgaggcccagacgtccgctaccggcaaccggcagcaccgccagatccggcgccagggtatcgacaatggcgctgcccggcagcgttgcggtattgcccgccgcatccgacgcgttgaccgtcatcgataccgttccctgcggcagggtttgcagatcggcaggcggcacggtgatcgcccagttgccgtcgctgtcgacggtggcggtgtaggtttttccgccaagcagcaccgagactttctgccccggcccgctgatgccggtattgcccgcaatggtctgcgccacatcccgctcgcctgcgctcagtataccgtcagcaaaaggcgtgttcagcgagggttgcggaacatggttaaccgccacgttcagaatatgttcatcagaggcagtctgcgtgccgagcgtaacggtggcggtgatttcacgcgggccgtctttcagctccgccagatcttcggcggggatcaccgcgctccagttaccggcgttatccaccacggcgtcgtaaactttgccgttgaactccaccagcaccgacaccgccggaccaaataccgtggtgacgccgcgcacttccagcggctgggtcacttccgccgcattcaggtagtcatcggtggagacaatagcgatggcgatgccggtctgcgcgctgtcgaccgtgatcggatggttgctggtgatagtctgattatttttatccaccacgctgacggtgatggtattgctgccattggcaagcgccagcagatcgcctgatggcagcgtgacgctccagctgccgtcgccctgcaccaccgcataccaggtttgtccgcccagggtgatagtcaccgtctgcccggcggcgatattttgcgtattgccggagagcgtttgatccagctggatctccgcgctgttaagcacatcatcgccggtgagcgggttaacgctgattgccggcgcggtgaggttaaccgtaaaatcactgctgccggtggtaatgttacccgccagatcggtgatttcgtagctgatggtgtagctttcgccatcgctcagcgcctgaagatccgtaagcgggatagtcgtttgccagttgccgttactgtcgacgatggcgaagtaatttttaccattaagggtaattaaaacggtgctgccttcatcagcagcctctgcatagccgcgcaggattttatccccgccaagctgggaactgtcaaatacctggttcggtacgaacggcaccgtgtccagcacaggcggaacagtatccaccatcacatccattgaagtttcaacggtgcgtccgcggaaatccagcagtcttacgcgcagcgtgctcggcccctgcgacaggctttgcagcacttccggcgggaacataaatgcccatgagccgtcgggattaacggtcgtggtccagacgttgtcgtcccacatgatggtaatgacactaccggcgttcgccgcctcggtcgaaccgctcagcatctgattgcgcgccaccagtagctgattgagcaggttatcctctgtcagaggttcaaccgtcagggttgaggttcctggcgtgctaccgccgccgtcaggaggtgtggtaccgccgccgtcagggggagtcgtaccgccgccgtccggcggagtggtgccgccgccatcagggggagtcgtaccgccaccgtccggcggagtggtgccgccgccatcagggggagtcgtaccgccgccatccggtggagtggtgccgccattgttattgtcgttatccccaccaccgccactaccaccggatgcggcagcaatacctacaatcccccccacggcagccagcccacccagtaccgccagcgctgaaataccgcctgcgccaatcaacgagtcgactgcgacctctgacatcgccgggacaatggcttcagcggtcattggcccggcatcggcggcaaacgggaacaccgcgtggtgcgcaccgagatcatcctcgaacaccagctcactgtgcagaccattttcatcaaggaaaaagaagcgctgatagcgaaccgtagagccatctttcatatggacgatcaggtcattgccttcgcgctcgtaaaagtttaccgaggcgggagaagcatttacgcgcacaatacttgtctgcgagagattaacgacgcgatcggcgttttgcggatattccatcacgatatcgccggtcttttgatttataatatccacggatccgggaaggccatttttcggcgccatattatattcctcttgcagcaagtgccttatgtcacgcacctgacgtatttattttgggtaagccaatggcagccaaagttatctggcagaattgggctcggtatggtttctggagcaatttatgaggcaaaatgttgattttactgggcttgatttttcatccattgcagaaatacgaaaatcatctgcttaaaatatataatcactttttcgtaataggcaaattccaatatcacaaattcatacatatttttttgggaaacaggatatatcctttatcactaaaataaaggttaagccctacttaaatgaacactcaagtgattacttagaatttgaataatgcaatgtgaagctaaaaagtaaattagaatatatcctgtatcctgttattatgataattaccatcatttattatttaatattcaggagcgcttcagacggatgaagcgctgcttacactctgtcactaccgtgctgttcacactttgagcgaacgcgcttctccagcgtccgacaggcttatggagtggtgtgctgggtcaaaaatctgttatactcagttcaacacattggggctgattctggattcgacgggatttgcgaaacccaaggtgcatgccgaggggcggtttgcctcgtaaaaagccgcaaaaaaatagtcgcaaacgacgaaaactacgctttagcagcttaataacctgctaagagccctctctccctagcctccgctcttaggacggggatcaagagaggtcaaacccaaaagagatcgcgtggatgccctgcctggggttgaagcgttaaaactaatcaggctagtttgtcagtggcgtgtctgttcgcagctggcaggtgaatgtaaagacagactaagcatgtagtaccgaggatgtaggaatttcggacgcgggttcaactcccgccagctccaccaatcatgattggacagtgcaaggacagcacctttaaaaacaggaagttaggtatcacggtaggactctgaccagacagtaacgtgaccaaaaaggatacgcaaaggagccgcggctccctagtgacaaaaaagcccgcatgtgcgggcttttttgtcatcctaaagttcacggcgcatttgccgatatttcatttattgcacccatacattagtacgatcttaagattgtaaatattttcttagcttcccttttcagcgtgacaagtgcattggcgatggtacaatttgcatcccatgcaagtggaatcaataataataattaataaaaatcaattgattactaaagaaaaaggcatccatgcaacctaaagcgcaggtagattcacaggcggttaacaacatcttatgggactacatctcgtctcataccattcctacgcaggctgaaattgacaaatttgaaaaagccataggccatgaagccgaacccatgcgctcataccttaatgggcttctcatggcatctctcaaagattttgatgctgcaatgtcctgctttcagaaagcgttgaaaaccgaaagtgagtttatcgcctcgaattaccttgcatatctcggcttttgcgcccataacaaattgcatagacaagaactattccgtttagaagagctctactgcacttctgaacatagaagagttgcacgcaacacagctttcactatcggtaacactaggttaattcgaaaatataaccttaaattgttagctttgtacgatggtgaagagcgtcagcaatacctggatgaaggcgctagaatgatttctttagttgaagagtttaagaaggcatcaactcttacgtctggggagattgaaactctttgcgacgaagttgaggggattgccaaccgccatggtgtaaactgcgttggcgctagttacttcgtttccactgaagaagataatgcatacattgttcgtgcagaaactgaagacccctatcttcttgcggaattaaatacagagctttcagaccttctcgctgatgaaaaataccttggaaaaccattcacttcttggttcaaaagtgacagaagcaggaaggaggaggctcaatgagcattaaaggcagagaatttatagagtttgcaggacgttgtattgaacaaggcgatgagattggttacagaaatgccattgggagggcttactatggcgcttaccatgaggtttcaggaattctcgaaaaagcaatcttcgtgcatactcatcaaagtatcagagactatttattaaaagagtcttggcttaaaggtaatgagccctttgataagatgaggcttatctctcttggatcaagacttaaacaaatgcatacaaaccgaatctctgccgattataatttggatgaaaactttagcgatgtagatgctcaggcagcgttgattcaagccaagaagttcattgaggatttggactcaatgtacaaacaaacatatcccgatcctttgaccgcaacttaagtcatcaactaggaaggtgcggagattcaatcctctcgtgctgaccaaaaattccagaaaaaccagccttttaaggctggtttttttatgcttgaaatttgcttggggaattactggggaataatgggggaaaaatccccgacgatttacagctagtgcgccctgacgaccggcaaatctgtccacctcgtcgtatagcatggtgacagcatttccctcttcatctgccatgccggctggacgccctgtccggcaaaatatagcgtgcccctgccctgtttattgagcctgtccatcagcatcatcagcgcgtcgctgtcggcccgcggcgcgttgtcatcaaacagattgagttgcgccacgccctggctgaaaaagtcgcccagcatgatccccgctttctggtaccggtggccatcgcgccatattgcatccaggcaacgcgtggccgccgcgatgatgtcacgggtatcctgcgtaggtgtcagcagtttagtgccgacgttgttgccgtagtaaggctcgttcaaagcaaagggcgacgttttcacgaatgccgaaatgtaccggcaatactgtcgttcgctgcgcaacttttccgccgcgcgggccgcatatgagcagattgcctggcgcatttcgtcgtagccggtgatccgctctccaaatgatcgggagcagacaatctcctgcttcgccggtgcaaattcttccagctccagacaggactcgccgcgcagctcccgcaccgttcgttcgagcacgacgttgaagtgtttcctgataaaccgaatatccgtgtccgccagctggatcgctttgctgatccccattgcttcgagctttttggcaatccgcctgccgacaccccacacttcttcaaccggcatcagcgccatcaaacggcgctggcgctcgacgttcgataaatcgaccacgcccccggtctggggatactctttcgcggcccagttagccagcttggccagcgtcttcgtctgggcgataccgacgccgcagcgcaggcgcgtatggcgccagacggtatcgcggatctccctcccgaaatcacccaggtcgcggcagttacgcacgccggtcaggtcacaaaaggcctcatcgatggagtagacctccacgcgcgggcatatttcttcgagggtggtcatcacgcgctgcgacatatcgccatagagctcgtaattactcgagaacgcgagcaacggctgcgggaaaggcgtctcgcgcagctggaaccacggcgtgcccatttttatgccgagctttttagcttcggcggatcgggcaatgacacaaccgtcattgttgctcagaaccacgatgggccgcccggccagatcggggcgaaatgcagtttcgcaactcgcataaaacgagttcatatcaacgagggcgaacattgcggtgcatcgtgttgatgacagaaatgacaacgccggcgatgtctaacccgtcggcgtcataaattgggatcggagggtatgccggattctcagccagcagttgaggcaccgggtgcgtcaccagtcttttgacggtgaattcacctccaagattggcaacgacaatatcgttatgctggggagtaaggctgaagtcgacgagaaggaatgagccatcaagaataccggcgccgatcatggaatcaccggagacgcgcagtgtgtaggttgaggaaggatggggaataagatgcgacaccagatcgatgccgctctcgatataatcagctgcagggctggggaagcctgcagaaacgagatccccgtacatgggaatatgtaccggaacctccggaaaaataaggcgttgtagctgcataattacctccttttaaattactgtttttatatacagtagttttaatcagaaagtaacgcaagagtttcacgttataccaccagcacaaagcttcaccgcttcgcttgtaagtttttctcgcccatggaattgtggcaattgtaaattaaattttgtgctttttttgcatgcaactaaacctgtttcgaagctggaaattttttgtacaaagtgcatacggccacgtcatagatgatggccacctgttttctgtccactccgttctctataagcctcccggcctgtgcccattgctctggcgataatttcggacgacgtccaccgattcgaccctttgcgcgagccgctgccagcccggcacgggttctctcaacaataagctctcgttccatttctgccagggcagacatgatgtgaaatatgaagcgtcccatcgggctggacgtgtcaatgctgtctgtcaggctacgaaaatgaactccgcgctgacgcagttcgtccaccaataaaaccagatttcgcatactgcgaccaagccgatccagtttccagaccaccagcgtatcgccctcttttaactccttgagcacccttttcagtgctggccgatttgcaacagtaccgctcattttatcttcgaaaatctgttcacatcctgcgcgttcaagcgcctgacgctgcagagcagtgttttggtcatttgttgataccctggcatagccaatttgcatatttttcacccgataaattttgccaaaaaatcaggtgaagttatctgcatggtatttgaagagcaatctctcaaatgtcggtttagccgcatccggaatgaataccgacattacatcggcaacaggcctcacgactacgatcatgcgtgatcagtgggtacctgataaggcgttaatcgttacgctggatgctggatctaacgt

SEQ ID NO: 8 - DNA, 43907 bp, Enterobacter sp SA187
cgtatgttcactccagagacttggtattcatttagcgtccgaagacgtttaagaatccatgtccttgagtgcccacacagattgtctgataaattgttaaagagcagttgcgacgcgctttagcgctgtgtcgcgaggtggcgtatattacgctttcctccctcagagtcaagcgtttattttcgcttttctctggcggccttcccggaggaggcctcctgacccgctggcctgtaagccgttgttccgtgtcagtggaggcgcattatagggatcccatttttttgcacaagccttttttggatctttttttctgagtgctgatttttcactcttatcgctgtgatcctgttcgatctgcgcaaattttgaggtgtaaaaggcttgcgccgtgcgaataatggacccaaagtcatcattatccttcgcaagtactgaggtatatatgtctgctgtcttacgtccttataaggatcttttcccaaaagtgggacaacgcgtgatgatcgatgccaccagcgtcgtcattggcgacgtccgcatggctgatgatgtggggatttggccgcttgtcgcgatccgtggtgacgtgaaccatgtcgagataggcgcacgcactaatattcaggacggcagcgtgctgcatgtcacgcacaagtctgcttataacccggcgggtaatccgctgactattggcgaagacgtcaccgtcgggcataaagtgatgttacatgggtgcaccattggcaatcgcgttctggtcggcatgggatcgattctgttggatggcgttgttgtggaagatgatgtgatgattggggcaggtagcctggtgccgcaaaacaaacggctcgaaacgggttatctctatctgggcagtccggttaaacagatccgccccttaactgaggcggaaatcgaaggactgcaatattcagctaataactacgtcaaatggaaagacgactatctggctcagggtaaccagatccagccctgatcgtcttcttgctgatcgtggatcagctgttcagcttcttcttcaatatcccagcggttagcctgaaaattatgcaaccactgttccggcgtatcgcctttaaaacgatacgccagcgagctgccctttattgcgcaggtaagctgcataccatttaccagcacgggaaagcataccgcctgcaattctgcatgccactcttcgcgatccggaaactggatggcctgattcattgcgctatttcctgcttcagctgattaatcaccgcttcagtttccggtaacaccccgtgccataacagaacagcatgagcagcctgcgccaccagcatacccactccatctgcgcactgttttgcgccatgatgctcacaccagttcaaaaacggcgtatttcctttctgatagaacatgtcataacagtacagatgcggatgaaccagcgattccgggatcgcggggatctcgccgctaatgccactggatgtcgcattaatgatcagatcaaattcatgatcccgtagttgatccattgccaccgccttgacgctgccggtatgcatgaagacgtttgccagcgcctcagcccgcgcaaaagtacggttagtgatggttacctggcaatccagagacagtaaagggagaagaaccccacgggcagcgccgcctgcgcctgtcagcaaaatacggaaaccaggcttaatgaagcccagccgctcaagatcgctcagcaagcccgtaccatcggtgttatcccccagcaaacggccatcctccagccgcttgagggtattcactgcccctgccagcgctgcgcgctctgtcagttcatcggcccgggcaaacgcctcttctttaaaggggaccgtgatgttagcccccttcccccccgccgcaaaaaacgcattcagggtattcacaaaatcatctgctggcgccagcacacgaccataagggtgatcaatttgcagctgctgcgcaaattgttgatgaataaacggagacttactgtgggcgatcgggttaccgaataccgcatagctttccatatattacccctgtcggaagcgctcgccggtcagcgcgtcacgtatttctgaagggttctgacgcccgccagtttcgccctccaccaccggaaaatgatcaccgaactgggcgcgtacttcttctgttgtacggcacggcggtaagcccgtcagattagcgctggtcgaaaccagcggtttgccgtaggcctcgcataaggccaccaccagcggatgattggtaacgcgtacagccagcgtatcaaaacggccggttaaccagcgcggcgtcgtgggtcgcgccgggaatacgaatgtcaccggacctggccagctggcaaagacggcctcacgctgcgattcattcagggcgctgtcgtcgatgtagggtttaagctgttcgaaattcgccgcgataaggatcaaccctttttccaccgggcgttgttttaactcaagcagacgctggactgcgatctcactatcaggatcgcagccgacaccaaaaacagcctctgtaggataagcgatgacttctttattattcagtaccgccaccgcgtcagcgatgcgatctgattgcaggttattcttcactgtttaattccgccggaaccggctttccacattgtttactggcgcaaaagcgtttaacgccctgcgcggttttcttttcgatgagtaacggatactggcagacaggacactcgccagctatcggtttaaaattgataacgaactgacagtcaggataaccatcgcaggagtagaaagttttgccgtaacgggaacgacgctgaaccagatgccccgtctgacactgcgggcaggtaatggcagtatcatcaggtttatcgatcagttcggtatgttcgcaagtgggatactgactacagccgataaacatgccgtagcgcccctgacgcagcaccagctcagcgccacatacaggacaaagctgcccctccagaactttaacgatatgaccgtcagcctggttttttagcggacgaacaaaatcgcattccggatacagggaacacccaaggaaaggtccgtgcttcccggaacgaataacaagctgagccccgcattgtggacagggctcctgattaggcaccgagaacagtgctgatttggccataacaactcttgctgctgcaacgatgatttagtgcagcataccttcattcacttcaaagagtaattcttccatctgctgataggcgttttcacatccggggatattaaacagtaccatcagaatgacccattttagatcttccagatcgaactctgcggtatccagcgccagcacgcgttcaatgaccatttcccgcgtttcgaggtttagcacctgaatctgctccaggaataacaagaatccccggcaactggcatccagcctctcacactcttctgcagtataaatacgaacagagagtgggtctgaagcgagctgcatcggttcggcgaggccttcctgataatcagccagcttttccagccacaataacgcgttgtagatgtcctcacgatcaaaaccagcgtctgtcagatctgactccagtttatcctgatccacgcgcaattcagcttcgttgtggatgtaagtctcaaacaaatacattagtacgtcgaacatggcttgccctccttaatcggacatagccgccgggtacaactgcgatccatcctgctaactccagttcgagtagctgagccacaatcactggcacaggttggccggcacgttcagcgacgacgtcaacaggtgttacctcatctcctacgttagccaggagctcaggaaatggcaatgccgcgttatccggttctgaagaattaattagcttatcgctgtgatctggcacccaatgtagcccatattgcaaactttccagaatctcctcaggcgatgtcaccagcattgccccctgcctgataagactatgcggtccttcacagccagggttgcccaatgggcctggcagagcaaaaacctcacgtccctgatccagcgcgcaacgtgccgtgaccagcgaaccgcttttcagcgccgcttccaccaccagcacgccgcggcttagtccactaataatgcggtttcgtcgcgggaagttccccggccagggcaccgcagataaagggaactctgaaaccagcgcgccgccagcattaaggatgccgtcggcaagcgcgcgatgccgctttggataaacgctgtgtaaaccgtttcccagtaccgccaccgttttacctttgccgttaagcgctgcgcgatgggcaatgctgtcgattcccagagccagaccactggtaatggtcacgccataacgcacaagctgttcacagaactgacggccccatcgctcgccataccatgagtgggcccgactaccgacgacacccagttgctgcgacttcagtacgccgatatccccttcgacaaagagcgcgccgggataatcgctgatggctcttagctgcggcgggtaagcggcatcagtggccagcaacagatggtggtcgggagccgtaagccacgccaggctgcgttcaatttcacccgcagccagcgcctgaaattttgcgatctgctgtggggtcagtccagcgtggcttaatgtcgaggtcgtgatatccgggttctgcaataaagattgcgcgacgttaagcatcttgtcgccatacagatcccctacgtaaatcaggcgcaaccaaatctctgtcagagtcatcctttccccttgccacaggcagcctcagcaatctttgcgattggtcactgatgctgtcaatcagagggggatttgtctagaataggaggaataatcttttctactcctgaacacaactctggaaatttatggcagttttgcacgtgttacatatcccggacgagcgtcttcgcaaagtcgctgaaccggtaaaagaagtgaatgcagacattcagcgtatcgttgatgatatgttcgataccatgtatgccgaagagggtattggcctcgccgcaacgcaggttgatattcatcagcgcattatcgttattgacgtctccgagaatcgcgatggtcgcctggtgttgatcaatccggaactgctggaaaaaagtggcgaaaccggtattgaggaaggctgcctgtcgatcccggagcaacgcgctctggtgccgcgtgcagagaaagtaaaaattcgcgcgctcgacagagacggtaagccgtttgagctggaagcggatggcctgctggcgatctgtattcagcatgaaatggatcacctggtcggtaagctgtttatcgattacctgtcgccgctgaagcaaaaacgtatacgtcagaaagttgagaaactcgaccgcctgaacgcacgggcttaaggataagaatcaacgtgtcagattcactacgtattatttttgcgggtacacctgactttgcagcgcgtcatcttgacgcgctgttgtcatccggacataacgtcgttggcgtatttacccaaccggatcgcccggccggacgcggcaaaaagctgatgccgagcccggtaaaagtgctggcggaagagaacggtttaccagtgtttcagccagcgtctttacgtccgcaggaaaatcagcacctggtcgccgacttacacgcagatgtgatggttgtagtggcctatggtctgattctgcccaaagctgtgctggatatgccccgtctgggctgcattaacgttcacggttcattgcttccccgctggcgcggagcggcgcctattcagcgcgcgctttgggcaggcgatgcggaaaccggcgtcacgatcatgcaaatggacgtcggcctggatacgggcgatatgctgcataagcttgtctgcccaatcacggccgaagataccagcgcgacgctgtacgataagcttgcagagttagggcctgccggcctgattgaaacccttgcacagctggcgggtggcacagcccaaccgcaggtacaggatgaagcgcaggtaacctatgcggagaaactcagcaaagaggaagctcgcatggactggtccctgcctgccgtgcaacttgagcgctgtatccgcgcattcaatccatggccgatgagctggcttgaaatcgacggccagccgctgaaaatctggaaagcgtcagttatccattctgagactaccgccgggccgggcacaattgtggacgccactaaacagggcatccaggtcgctacgggcgacggtattctgaatatagaatcgctgcaaccggccggtaaaaaagcaatgagcgcgcaagacctgctcaactcccgccgggaatggtttgttcccggacatcgtcttgcctgacgagcatcacgtctcaagcccggggttaccgggcatttttattttgtggctatgaaaaaaaatattaatttacgcagcatggcagcccaggctatcgaacaggtcgttgaaaaaggccagtccctcagcaatgtcctgccactgttacagcaaaaagtatccgataaagataaagccctgcttcaggagctgtgttttggcgttctgcgtaccctgtcgcagatggagtggctgatcaataaattgatgtcacgcccgatgaccggaaagcaacgcaccattcattatctgatcatggtagggttttaccagctcctgcatacccggatcccgccgcatgccgcgcttgcggaaaccgttgaaggggccgtggcgataaaaagaccacagctaaaaggcctgattaacggcgtgctgcgtcagttccagcgtcagcaggaaacgttgctggccgaattcgcttccagcgagagccgctttctccatccggagtggttgctgacccgcctgcgtaaagcgtatccgcggcagtgggaagccattgtcgaagcaaataaccagcgtccaccgatgtggctgcgcgtgaatcgcaatcaccactcacgcgatgcctggctggccttactggaagaaacagggcagcaaggttttacgcatccagactatccggatgcggtgcgtcttgagtcccctgcccctgttcatactctgccaggcttcgaagaaggctgggtgaccgtacaggatgcgtcggcccagggatgcatgacttttcttgagcctgaaaacggtgagcacattctcgatctgtgcgcggcgcctggcggcaaaacgacgcatattcttgaagtggcgcctgatgctcaggtgctggcggttgatgtcgatgaaaaacgcctgtcgcgcgtttacgacaacctgaaacgtctgggcatgaaagcgcaggtgaaacagggcgacgggcgtttcccggcccagtggtgcggtgagcagcagtttgatcgtatcctgctggatgcgccgtgctcggcgacaggggttatccgccgtcatcctgatattaagtggctgcgtcgcgatcgtgatattgccgaactcgctcagttacagtcggagatcctggatgccatctggccgcaccttaagcctggcggcacgctggtctacgcgacttgttccgtattgccggaagagaacagtcagcaaatcgccgcgttcctggcacgtacgcctgatgcaaaactcagcgttaccggcacgccggacaatcctggcaagcagaatctgccgggtctggaagacggcgatggcttctattacgctaagctaatcaaacagtgactgaaatgacgggccgcaactgatgaagattatcattctgggtgccggacaggttggcggcacgctggcagaaaacctggtcggtgagaacaacgatattactattgttgatattaacggtgacaggctgcataacctgcaggacaagtttgatctgcgcgtggtacagggtcatggctcacatccgcgtgttctgcgagaagcaggggccgatgatgccgatatgctcgtcgctgtgaccagctctgatgaaaccaacatggttgcctgccaggtcgcttattccctcttcaatacgcctaaccgcatcgcgcgtattcgttcacctgattatatccgcgatgcagataagctctttcacaccgaggcggttcctatcgatcacctgattgctcctgagcaactggtcatcgacagcattcaccgtctgatcgaatatccgggtgcgttgcaggtcgtgaattttgccgaaggcaaggtcagcctggcggtggtgaaagcttattatggcgggccgctggtcggcaatgcgttgtccaccatgcgcgaacacatgccgcatatcgatacgcgtgtcgcggcaatttttcgtcatgaccgtcctatcaggccgcagggatcaaccatcgttgaagcaggtgatgaggtcttctttatcgccgcttcgcagcatatacgcgcggtaatgagtgagcttcagcgtcttgaaaagccttacaaacgcatcatgctggttggtggtggcaatgtgggggcgggtctcgcgcgtcagctggaaaaagactacagcgtgaaactgatcgagcgcgatcaaaagcgcgccgctgagctggcggaaaagctgcaaaacaccatcgtcttctatggtgatgcgtcggatcaggagttgctggcggaagagcatatcgatcaggtggatctctttattgccgtcaccaacgatgatgaagcaaatatcatgtctgccatgctggcaaaacgcatgggggcgaaaaaagtgatggtattgatccagcgccgcgcctatgtggatctggtacagggtagtgtgatcgacattgcgatctcaccgcaggaagccactatctctgccctgctcagtcacgtccgtaaagccgatattgtcggcgtctcctcactacgtcgcggcgtggctgaagccattgaagccgtggcgcacggtgacgaaagtacatctcgcgtggtgggcagagtgatcgatgatattaaacttcctcccggtaccattattggcgcggtcgtgcgcggcaatgatgtcatgatcgctaatgacaatttacgcattgagcagggcgatcacgttattatgttcctgacagataagaagtttatttctgacgttgaaagactattccagcccagtcccttcttcctgtaatcttttaaaggcgctaaaaatagcgccttttttatttaatcccttcatttacaaaggattagtaatttaactcaattgtcctgcttacatggaaaataaagtgagctttgttagacttaggtgggtctgcggtgataaggagaataaaatgagcatgttaaaagagtttcgcgcgtttgcgatgcgcgggaatgtaatcgacctggcagtgggtgtcatcattggtgcggcattcggtaaaattgtctcttctctggtggctgacatcatcatgccacccctgggcctgttgattggcgggattgattttaaacagtttgcatttacgctacgtgaagcgcagggcgatattcctgcggtagtgatgcattacggcgtgtttattcagaatatttttgattttctgatcgtggcgttcgctattttcctggcgatcaaactgatcaatagacttcatcggaagaaagaggaagagccaaaagcaccgcctgcgccttccaaagaagaagtactgttaacggaaatccgtgatttactgaaagagcaaaacagccgtcccggtctttaacagacgacggaaacaagaaggccagtggcaaaaaagtgcttcactctcttgccactggcctcctgaccactccgttttgcatgtttcgcttttcgcagataactgcctttgcctttcttgtttttctcaatacgctgacgaaacagcggatcatggagtaatgcttccagggcgttatcgttaatctgccctttctggtgctgatagcgactcatattttctccggaatgttatataaaacgtggcgagtgtagatctgactttgctaaagatcaactgcctcagttttactgccacttccctgctccagggcttcaaggatcgaacaatagatgctgctatgggcagtaccgcagcaggcatcgtttagtcgctgcaaagagcgccgcatagtttgtaactcttctatccgctcttcaacttcgcttagcctggcttgtacgatactttttgattcctggcaggtgtggtgctcaggatcaacgcgtatcgacaaaagctcccgaatcgactccagggtgaatcccagttgccgggcatgacgtataaacttcagacgctgaagatcgttatcggtataaaggcgaaaaccgccctgggtgcgcacttcgtgatccatcatttgctgcttttcataataacggatggtatcaggggtcacctcagccagtctggccagttctccaatgcgatacataagagctcctcatgcagttatggcaaattttaagcatacccgcacagggtaacgaataaaatcataaaggcatttgtgaaggcattaaagggaggggtgattaagggggcgggacggaaataaaaaaacccgccgaagcgggtttttctatattactgcagattactctgcagcagcttctgctttcgattcagagcgatcaaccagctcgatgtatgccatcggcgcgttgtcgcctgcacggaagccacacttcataatgcgagtgtaaccaccggcgcggctcgcaaaacgcgggcccagctcgttaaacagttttgccacgatctcgttatcacgagtacgggcgaatgccagacgacgattagctacgctatcagtcttggcaagagtaatcagcggctcaactacgcgacgcagctctttcgctttaggcagggtcgtcttgatgatctcatgacgaaccagtgaacctgccatgttgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacaaaccacgggaagccagcacgtctttaatctcagtaagagattttttaccaaggttaggcgttttaagcagctcaacctcggtacgctgtaccagatcaccgatatagtggatagcttctgctttgaggcagttagcagagcggacagtcaattccagatcgtcaacagggcgcagcaggatcggatcgaattctggtttctcttctttcacttccggctgacgtacatcacgtaagtcaacgaaagcttccagttgttctgccaggatggttgccgcacgacgaatcgcctcttcaggatcgattgtgccgttggtttccatttcgatgaccagcttgtccaggtcggtacgctgttctacacgcgctgcttcaacattgtaggcaatacgctctacagggctgtaacatgcgtcgaccagcagacggccgattgggcgctcatcttcttccgaatgaattcgggcagaagccggcacataaccacgaccgcgctgaactttgatacgcatgctaatagacgcgttctcatcggtcaggtggcagatcacgtgctgcggcttgacgatttcgacatcaccatcatgggtaatgtcggctgcagtcacagggccaatgccagatttattcagggtaagaataacttcatctttaccttgaactctcaccgccagccctttcaggttgagcaggatttccaggatatcctcctgaacaccctctttggtgctgtactcatgaagtacaccatcaatctcaacttcggtcaccgcgcaacccggcatcgatgagagcagaatacggcgcagtgcgttacccagagtatggccaaagccacgctctaaaggctcaagggtcaccttggcgtgcgtcgaactcacttgctcgatatctaccaggcgcggttttagaaactctgtcacagaaccctgcattgtgtcctctctttggtactaagctttacttggagtaaagctcgacgatcaggtgttcgttaatgtccgcagacagatcagaacgctcaggcttacgcttaaacgtaccttccatcttgccaccatcaacttccagccaggttggcttttcacgctgctcagccagctccagagcggctttcacgcgagattgctttttcgctttctcacggatactaaccacatcattcgggctaacctgataagaagcgatgttaacaacacgaccgtttaccatgatagccttgtggctaaccagctgacgtgcttcagcacgagtggcgccgaagcccatacggtatacaacgttgtccagacgaccttccagcagagccaacaggttttcaccggtgttgcctttcagacgtgctgcttctttatagtagttacggaactgacgctcaagcacaccgtagatacggcgaactttttgcttttcacgcaactgtacaccatagtcagacagacgcggtttacgcgcaccgtgctggccaggagcttgttcaatcttacacttggtatcaatcgcgcgaacgccagacttcaggaacaggtctgtgccctcgcgacggctcagcttgagcttaggacccaaatatcttgccattttctttctccaacattcctaaaaacgagcgttatacgcgacgttttttcggcggacgacaaccgttgtgagggatcggagtcacatcagtaatattagtgatgcggaaaccagcggcgttcagagcacgaatggtagattcgcgacccggacccggtcccttgaccataacttccagattcttgataccgtattctttcacggcgtcagcgcaacgctcagctgcaacctgagctgcaaacggagtggatttgcgagaaccacggaaaccggaaccaccggctgttgcccaacccaaagcgttaccctgacgatcagtaatagtaacgattgtgttgttgaaagaagcatggacatgagccacgccgtcagagacttgttttcttacacgcttacgtgcacgaactggtgcctttgccattattcaatcaccccgattatttcttgatcggtttgcgcggacccttacgggtacgtgcgttggtcttagtacgctgaccgcgcacaggcagaccacgacgatgacgcaaaccgcggtagcaaccaagatccatcaggcgcttgatgctcatgctaacttcacggcgcagatcaccttcaacgacaaatttggcaacttcgtcacgcagcgtgtcgatttgttcttcagacagctcactgatcttaacatcttcagcgatacccgcagaagccagaatggctttagaacgggtcttgccgacaccgtagatcgaggttaacgcgatcacagcgtgtttttgatcaggaatgttaatgcctgctatacgggccactatgcactcctactatttaatatgtacgcaccatgctgaaaagcccgttttcaggatactcaaatggatacgcacagacatacaaaagattggctggctaatctagccagctcaacccaactttgcaagaaaaatatgcgaattaatcagccttggcgctgtttatgcttcggctcggcactgcaaatcacgcggatgacgccatcacgcttaacgattttgcagttacggcataatttcttgacggaagcacgaactttcatttttactctccgtaacttctcgagcgacctttagcggccatagcctttaaggttcgccttcttcaatgcagactcgtactgactggacatcatcagagtttgcacttgagccataaagtccataatcacaacaacaacgataagcagtgaggtcccaccaaagtagaacggtactttcattgcgtcacgcatgaactccgggatcaggcagataaaagtaatatagagcgcgccgaccagggtcagacgtgtcattactttatcgatatacttcgccgtttgctctcccggacgaattcctggtacaaatgcaccggacttcttcaggttatctgctgtttctcgcgggttgaaaaccaacgccgtatagaagaaacagaagaagatgattgcagacgcatagagtaacacataaagcggttgccctggctgcaaatacagcgaaattgttgtcagccagttccaaccggtaccgcccccgaaccatgacgcgatggtcgccgggaacagaataatgctggaagcgaagattgccgggataacccctgccatattcactttcaacggtaaatgtgtgctctgtgcagcatagacacgacgaccctgctgacgtttcgcgtagtttaccacaatgcggcgttgaccacgttcaacgaaaacaacaaagaacgtcactgcaaatactaatactgcaaccaacagcaacaggaggaagtgcaggtcgccttgacgcgcttgctcgatcgtatgggcaatggctggcgggagtcccgcaacgataccagcgaagataatgattgagataccgttaccgataccgcgttcagtgatctgttcgccgagccacatcaggaacatggttcctgtgaccagacttacaacagcagcgaaatagaatgcaaagcctggattgattaccagaccttgcataccaggcatattcggcagaccggtagcaataccgatcgactggaatatcgccaacaccagagtaccgtagcgggtgtactggctgatcttacgacgaccagactccccttctttcttcatttctgcgagggtcgggtgaacgaccgtcaacagctggataataatcgacgccgaaatatacggcatgatacccagagcaaagattgaagcacggctgagtgcaccaccagagaacatgttaaacatttcaatgatggtgcctcgctgttgttcaagcagtttggcaagtacagtggcatcaataccagggatcggaatgaaagagccaatgcggaacacaatcagcgcgccgattacaaacagcagtctgcgtttcagctcgcctaagccacctttggcactttgaaaatctaatcccggttgtttagccatctgctacttattcctcgattttaccgccagcagcttcgatagcagcacgagcgcccttagaaacacgcaggccacgaacagttaccggagttgaaacttcaccagccaggatcactttcgcgaactcgatctggataccgataatgtttgctgctttcagcgtattcaggtctacaacgccgccttctactttagccagatcggacagacgaacttctgccgtgatcatcgctttacgagaagtgaagccgaacttcggcagacgacggtacagaggcatctgaccaccctcgaaaccacgacgtacgccaccaccagaacgagagttctgacctttgtgaccacgaccgccggttttaccgaggccagaaccgataccacgaccaaggcgtttacccgccttcttagagccttcggccggagacagagtatttaaacgcatctcttactcctcaactttaaccatgaaggaaaccgcgttgaccataccacgaacagcgggagtatcctcgcgctcaacggtatgaccaatacgacgcagacccaggccaagcagcgttgccttgtgtttcggcagacgaccgattgcactgcgggtttgagtgattttaatagtctttgccatggtcaattaccccagaatttcttcaacggatttaccacgcttggcagcgaccatttctggagaattcatattttccaggccatcaatagttgcacgaaccacgttgatcgggttggtggaaccatatgctttagccagaacgttatgaactccagcgacttccagaacggcgcgcattgcaccaccggcaataataccggtaccttctgaagccggctgcatgaatacacgagaacccgtgtgaacacctttaaccgggtgctgcagggtgccgtggttcagcgcgacgttaatcatattgcgacgggctttttccatcgctttctggatcgctgctggaacttcacgcgctttaccgtaaccaaaaccaacgcgaccgttaccatcgccaacaacagtcagagctgtgaaggagaaaatacgaccacctttaacggttttagatacgcggttaaccgcgatcagcttttcctgcagttcgccagcctgtttttcgatgtgagccatcttacacctctaccttagaactgaaggccagcttcacgggcagcatctgccagtgcctggacacgaccatgatattggaacccggaacggtcaaaggaaacatctttgatgcctttttccagagcgcgttcggcaacagctttacccacagctgcagcagcgtctttgttaccggtgtacttcaattgttcagcgatagctttttctacagtagaagcagctaccagaacttcagaaccgttcggtgcaattacctgtgcgtaaatatgacgcggggtacgatgtaccaccaggcgagttgcacccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctgaccgatcagctgtttatcagcgcctttcagcacgatttcagtctgagtcggacattctgcggtgatccccgctggcagctgatggtctacaggatgcgagaaacccagagacaggtttactgcattgcctttaaccgctgcgcgataacctacaccaaccagctgcagcttcttagtgaagccttcggtaacaccgataaccattgagttcagcagggcacgcgcggtaccagcctgagcccatccatccacgaaaccagcacgcggaccgaaggtcagagcattatctgcatgattcacttcaacagcatcgttgagagtacgagtcagctcgccgtttttacctttgatcgtaataacctgaccgttgatttttacatcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccatgccggccataaccttcggcagctcatcttttttcttatagatgcgcagacctgggcggctgacacgctgaatgctttctacaacagctttaccctggaaatacttaagagtcagttccagttccggcttggtgtcgccttcaactttaaattcttcaataaaaccttcttccttcagcacgttggcgattgccactttcagcttggaggaaggcatggtgaccgcaactttgttcgcggcctgaccgttacggatacgggtcagcatatccgcgatcggatcttgcatgctcatctgtctttactcccgtgattcaattggtgacaattaccagctagcctttttcagacccggaatttcaccgcgcatagcggcttcacggaccttaatacggctcaacccgaacttccgcaggaaagcgtgcggacgaccagtttgacggcagcggttacgctgacgagacgggctggaatcacgcggcagagtctgcagcttcagaactgcattccaacgatcttcgtcggttgcgttcacatcagagatgatagctttcagttcagcgcgtttagcgaagaatttatcagctaaagctacgcgttttacttcgcgtgctttcattgattgcttagccattcagtaaccctaccttacttgcggaacgggaagtcaaaggcagccagcagagcacggccttcttcatcagatttcgcagtagtggtaatggtaatatccaaaccacggacgcgatcgactttgtcgtaatcgatttctgggaagatgatctgctcacggacacccatgctgtagttaccacgaccgtcgaaagacttagcggacaagccacggaagtcacggatacgcggtacagcaatagtgatcaggcgctcaaagaactcccacatgcgttcgccacgcagagttactttacagccgatcggatagccctgacggattttgaagcctgcaacagatttgcgtgctttggtgataaacggtttttgaccggagattgctgccaggtcagctgctgcgttatccagcagtttcttgtcagcgatcgcttcaccaacacccatgttcagggtgatcttctcgacccgagggacttgcatgacagaattgtagctaaactcagtcatgagttttttaactacttcgtctttgtagtaatcatgcagtttcgccatcgtactactccaaattacttgatagtttcgctgttagacttgaagaaacggacttttttgccgtcttcgaatctaaagcctacacggtcagccttgccggttgccgcattgaagatagcaaggttagagatctgaatagctgcttctttctctacgatgccgcctggttggttcagagccggaaccggcttctggtgtttcttaaccaggttgataccttcaacgatgaccttgccggaagacaggacattttttactttaccgcgcttacctttatctttaccggttaacacgataacttcgtcatcacgacggattttagctgccatgattcgctccttagagtacttctggtgccagagagataattttcatgaacttttcagtacgaagttcacgagttaccggcccaaaaatacgcgtaccgataggctgctcactgttattgtttaaaataacgcatgcattaccatcgaagcgaatgacagaaccgtccgggcgacgaacacccttcctggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacggtcagcatagtctgttcttggatcatttcagtgctccgctaatgtcaactactactttgggacccaaatctcgggtcgttaaaaagccccatatcgggggcgcggcattataacaccgcttcttagatatgggtagaaaaaataaacggcccatttctggaccgtttatcgttgagaacgcgtactgtattacagaatcgctttctctacaacgcgaaccagcgtccaggacttagtcttggacagcggacggcattcgcggatttcaaccacgtcaccagtaccgcattcgttgttctcgtcatgtacgtgcagtttggtcgtacgcttgatgaatttaccgtagatcgggtgtttcacaaaacgttcgatagcaacaacgatggatttctccattttatcgctaacaacgcgaccttgcagagtacggattttatcggtcattacgcacccgccttctcagtcagtaaagtcttaacgcgtgcgacatcacgacgcacttgcttcaacaggtgagactgttgcagctggccactggctgcctgcatacgcaggttgaactgctcacgcagcaggttcagcagctcggtgttcagctcttcaacactcttctcacgcagctcttttgctttcattacatcaccgtcttagttacaaaggtggttttaatcggcagtttcgctgctgccagcttgaatgcttcacgggccagctcttcagacacaccgtccatttcgtacaggactttacctggctgaatcaaggcaacccaatactccacgttacctttacctttacccatacgcacttcgagcggcttttcggtgatcggtttgtccgggaatacacggatccagatcttaccttgacgcttaactgcacgggtcatagcacgacgtgctgcttcgatctgacgtgcagtcagacgaccacggccaacagctttcagaccgaaagtgccgaagctaacatccgtaccctgcgccagaccacggttgcggcctttgtgcactttacggaattttgtacgctttggttgtaacatcagcgacgctccttatttccggcctttacgctgctgctttttaggttgagcagccggtttttccggttgttcaacagcagccataccacccaggatctcacctttgaagatccacactttaacgccgattacaccataagtggtgtgcgcttcagaggtgttgtagtcgatgtcagcacgcagagtgtgcagcggaacgcgaccttcacggtaccattcggtacgtgcgatttccgcgccgcccagacggccgctaacttcaactttgatacctttagcgcccagacgcattgcgttctgtacagcacgcttcatagcacgacggaacataacgcgacgttccagctgtgaagtgatgctgtcagcaaccaatttagcgtccagttccggtttacggacttcggcgatattgatctgtgcaggaacgccagcgatatccgctacgaccttacgcagtttttcgacgtcttcgcctttcttaccgataacgatacccgggcgagcagtgtgaatagtcacacggatgctcttagccggacgctcgataacgatacgagatacggacgccttcgccagttccttagtaaggtactgacgaactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtaatgtggctggtgcgcttcaggatgcgatctgcacgacctttcgcacgcggcataatgcgcttcatgcttgggccttcgtctacgaaaattttcgcaactttcagatcgtcaatgtcagcgccatcgttgtgttcagcgttagcaatggcagattccagaaccttcttgaccagtacagccgctttcttgttggtgtaggtcaaaatgtccagggcctgcgacactttcttaccgcggatcaggtctgccaccaggcgaaccttttgagcagaagaacgagcgtggcgatgttgagctaaagtttccatctcttcctcctacttatttcttcttggcttttttatcagccgcgtgaccgcgataagtacgtgtcggtgcaaattcacccagtttgtgaccgaccatttcgtcggaaacaaataccggaacgtgctgacgaccattatggacagcgatggtcaaaccgatcatgtttggaaagatcgttgaacgacgggaccaagtgcgcaggggcttcttgtcaccgctttccaccgctttctctaccttcttcagcaagtgcaggtcaataaaaggacctttcttgagagaacgtggcatggcttatcctctaatattatttgctacggcgacgtacgataaatttatcagtacgcttgttgctgcgggtcttcttacctttggtctgaacgccccacggagttaccgggtgcttaccaaagttacgaccttcaccaccaccatgtgggtgatctaccgggttcatcgccgtaccgcgaacggtaggacgaacaccacgccagcgtgcagcacctgctttacccagaacgcgcagcatatgctcagcattgccaacttcgcccagagttgcgcggcagtcagcttcaactttgcgcatttcgccagaacgcagacgcagggtgacataagcaccatcacgagcaacgatctgaacataggtaccagcagaacgcgccagctgaccgcctttacctggtttcatttctacgttatgaacggtagaaccaaccgggatattgcgcatcggcagggtgttacccgctttgatagcagcatcaacgccagactgaatctggtcgccagctttcaggcctttaggggccaggatgtaacggcgttcgccgtctttgtacagaaccagcgcgatgttcgcggagcggttcggatcgtactcaagacgttcaacaacagccgggataccgtctttgttgcgtttgaagtcaacaatacgataagcctgcttatggccgccaccgatgtgacgagtggtgatgcgaccattgttgttacgaccaccggatttgctgtttttttcaaccagcggagcaaaaggtttgcccttatgcagctcagggttaaccactttaacaacgtggcgacgacccggagatgtcggtttacacttaacaactgccattgtattactcctccgacttactcagcgccgccaacgaagtccaggttctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttaccaactttgagaacgatggtattggttttttccatcgcagtagacgctttttcagaaacgtgcggcgcacgaagcaccttcagcagacgttcttcacgaatcatgccagcatctcctcaacttgcttaacagcatcagcagtcattacgactttgtcgaaggcgatcaggctaaccgggtcgatacctgctgcgtcacgtacgtcaaccttgtgcaggttacgtgcggccaggaacaggttctcgtccagctcaccggtgatgatcagcacatcttccagagccatgtctttcagtttctgagccagcagcttagttttaggcgcttctacagagaactgctcgacaacgatcagacgatcctgacgtaccagttcggacagaatgcttttcagcgcgccgcggtacatctttttgttaactttttgactgtggtcctgcggacgcgcagcgaaggttacgccaccggaacgccagatcgggctcttaacagaaccagaacgcgcacggccagtacctttctgacgccacggttttttaccagaaccggttacttcagcacgggtcttctgagcacgagtaccctgacgagccccagctgcgtaagcaactacaacctggtgtaccagcgcttcgttgaaatcacgaccgaaggtagtttcggaaacagtcagcgcgctctgcgcgtctttcaatactaattccattgctatctcctcacgccttcacagctggtttaacgatcaggtcgctaccggttgcacccgggacagcacctttaaccagcagcaggttgcgctcagcgtcaacgcgtactacgtccaggctctgaacagttacacgttcgttacccagctgacctgccattttcttgcctttgaacactttgcccggagtctggttctgaccgatagaacccggaacgcggtgagacaaggagttaccgtgggtagcgtcctgggtacggaagttccagcgcttaacggtaccagcaaaacctttacctttagaggtaccggttacgtcaacttttttaacttcagcaaacagctcaacgctaatgtcctggcctacagagaattcttcaccgtcagcaagacggaattcccacagaccacggccagcttctacgccagctttagcgaagtgacccgcttcaggcttggtgacgcggttagcttttttagcaccggtggttacctgaacagcacggtagccgtcgttagccaggtctttaacctgagtcacgcggtttgcttctacttcgattacggttactgggatagagacgccatcttcagtgaagatgcgggtcatacccacttttttaccgactaaaccaatcattgtatcaacctctcaatcgctcgatgacctgattaacccaggctgatctgcacgtctacaccggcagccaggtccagacgcatcagagcatcaacggttttctcggttggctcaacgatgtcaaccagacgcttgtgagtgcgaatttcgtactgatcgcgcgcatctttgttaacgtgcggagagatcagaacggtaaagcgctctttgcgggtcggcagcgggatcggaccacggacctgcgcaccagtgcgcttggcagtctcgacgatttccgcggttgattgatcgatcagacgatgatcaaacgctttaagacggatacggattctttggttctgcatgagaccagagctccaattattttatagacaaatagctactcctcatacccattacgattgatgggagagtgtaaccgttcttacagagttccccgattgggaacattgtttggtagccaaaagcgctgccagggttcatattgaaccagccgtcaattacgacaagccggcgtattatacttatacatggcccggatgcaaggtcttacgcttcaaaattgcacgatattcgcggccccgtcactgttcttcaccctgcacctctttcagcgcttgccggacgcgcagccgcaatgcgtcatggtcgcttgcggtgtcctcgcgctcgtcgtccaaagccgcatcctcatcgctggacagcagttcatcggccattatcccctcttcttctgcttcatcggtttcaatctcaatgcgggcaggcaacggtttctttttaaacacataatgcacatcggaaagccagtagttacgggctggttcatatgcagcgcggtctgagatctcaggtaagaaccgctgcccgatgacgtgcccgtaatagccgcacgccagcatcaggatgatccatagtgcccagccccctgcccgcagaccatggcgcctgcgctcgtctggtgttgctttcagcgtgacggcgcctttgtccccattttgcgcctggtaagccctgaagatccgcatcatttcgcgctttcctttattgctactgtatctgacgtactttcattaataagctgcggcgcctcgcccagcgcttgctgtaaacggatcagcgtgcgttttcccggtttgccatcctgcctgagattttcccgttgctggaagagcttcactttctcggtgagcgctggcgtccattcaccttgcttgtcgaccggcacgttgagcgcccggctgagtaacgcatccagccagacgatactttccggcgagcttttatcggaaaccgtgatttttccgtccggcgtctgcttttccatcagcacatagtttccgtcccagtgcgctgtaaaccagtcgcgccgcactgtccacgtcttaccggcaatcagcagatcaagttcagtgtccgacatgcgcatcaccaccgcatgtaatcctttatttatgcgtaactgcgccatccacggcagctcacgcccggccagatcgttcaggctcgctttgccactttcgcaggcaagttctgcgcgtccggcctgatcgcaccaggcctcttcagggaggacgtcatagccccaggtgctgaacagctgttgcatggcgtcgcgcatgtgggttccgctatcggtgatatcaacgaccggctctttttcttctgtggggatcatcatccagcccggaacaggaagcgccggttttagcgtatcgacactcagccagccaacggtgaatgccagcccggcgtatagcgccagcaggctgccacagcgtgccgcgctgcgttgcggcgccagcagattcagtaattgcccttcctgtcgcgctgtcagcgtggtcatctggcctgcaagcgccagctgatatgccgatctggctatacggctgagcagtgcaaggttgcctcgcgccgcgtttgctgcccgatcggtaaacgcccggcgcagacttaccacttccccctcattcatctggtgaagcataaatgcatgggtttcgtcactgtcgggcagaggcatgccgatcggaaaatcgatttgtgatttgattttccggtgacgcattaacgccttgctgcctgccaacagcaggctgacgcctgcctgccgggacgctgccagctgacggaaatcatgtatcagcaccggcaggtgacggctcagcacatccgcattatcaataatgaacagtacaggttggtcggcctccggcaccgctgacatcgcgtgctgccagaactgcgttatcgcaacaggctctgcattaacgggcgcggcgggcatcatccggcaacggtacgcttcgccaccagcccgccagacgcaggcgtgtccggggtaacccgccgcgagttggtgcgccagcgtcgattttccacatccgggcgcaccatacaacaggcccacactgccagaccgcagctcctgaacaataaaggttttaattaattcatatcctgaaaaaggatataacgtcgatagacgttctgtactgctcatttataaaaggtcatccatcagagccgttaatattatcaccacagaatataagaagaatcgtacagttatttcactacaatcatcattaaatatgatgaggttgaatacgatatttaaagactataccatattcagcttcttcaggataagtacgcagactcatggatacaagaattcagcaactggctggcgctattaaacaacaaagacagaccgtattatgcggactgctggtttgcttatccgcgatacttattatttattccgtgtatgattacgcgcaattgtcccgtaaatttactccgcaagatgagcccgcaggcgtttcgcggcgcatggccgcattcagcctgccaatgaacatgccgcagaataccgaggccttgccgaaaaatagtgataaccccagacaacaccaaagcacgccgctcaatctcattgttaatggtgtcatcgccagcaccttaagaaatcgctcccaggccattattacggtgaataacaaaacagaaatatataattttggtgattatatagaagatcttcccggcgtctttatttcctcgatcgacagcaacagcgtaaccattaataataacggtgagccacaaaattttattttgaatgattcacccgaattatcattatcgacatcgttatcgtcagcggcttcggaaactggcacggtttatctcggcgatctcctgattaccaatctggtttatcagcaggacgctttacagggcatcaggttgaatatgcgtaccgacgccgccggatcccttacggcgggactcaagcccggggatctggcgattaagatgaacagctacagcctgacgcgcaaagattccgcagaagcggccattcaggcgctggcctcattacgcaccgcgcaattcaccgtgctgcgcgatggacaggaagaactggtcaacgtgtcaacggacgcggatgacaataataaggataactaaattgctcaagggaatgacacgaactgccgcatggatgctggccttacaactttgttgcagtgccccttcatcggtggcggcgcagtactctgcaaacttcaaaaatgccgacatcagggattttatctcttcagtcagtaagcaaatcggcaaaaccattctggtcgatccctccgtccagggaagtatctcggtccgcagctttgataacttcaatgaggcggagtattaccagttcttcctcagcgtactggatatctacggttataccgtggttacgctggataacggcttgctgaaggtggtgcgttccgctgcgcttaaaaccgcgcccggcgtactgcaggagtcctcgcagccagcagtgggcgatgagtttatcacccgcgtggtatcgttaaaaaacgtgcctgcgcgcgatcttgctccgctattacgccagatgatggagggcggcggcatcggtaacgtggtgcattacgatccctcgaacgtgctgctggtgaccggcaaagccactatggttaaccgcattcttgaagtggtgaagcgggtggatgtgattggcacacaggagcgggaactggtgaagctgcgttacgcctcggcggtcgatctctcggaagtgatcaacaacctgctacgcgaagaatcaaaagaaaacccgacgcagatcctgttgccgaaagtcgtcgccgacaaacgtaccaacgccctgctcatcagcgggccagacaacgtgcgccagcgtctgaaatccctggtctacaagctggatattgagcagaccaacctcggcaacactcgcgttttctatctgcagtatgcaaaagccagcaaaattgtcgaggtgctgaccggcgtctcggcaaagctgtctgaagacaaacagtcctcgccgcagagcgtgtcatcgggccccagcgatgtctccattactgccgatgaacagaccaactcaatcgttattaccgccgatcaaagcaccctccaggagctggaaaaggtgatcgcgcggctggacattcgccgcgcgcaggtgctggttgaggcgatcatcgttgaagtacaggatggcaaagggctgaacctgggcgtgcagtgggcgaataacaatgttggcggtcaacaatttacccagaccgggctgccaatttttgatgcttcccagggcgcgcgccagtttaaagaaagcggttccatgagcagcgataacgctatctccagcgcgctgagcagttttaacgggctggcgacgggctttttcgagggcgactggagcgtgctgctcaccgcgctggcgtctgataacaagaacgatattctcgccactcccagtatcgtcaccctcgataacaaagaagcgtcctttaacgtaggccaggatgtccctgttctttccggctcgcaaaccacctccggcgataacgtctttaacaccgttgagcgtaaaactgtcggtactaaactgaaagtgacaccgcaggtcaacgaaggcgacgccgtcctgatggagatcgagcaggaggtgtccagcgttgacagctcatccggtaacgccagctccctcggccccacgttcaatacccgcaccatacaaaacgccgtgctggtgaaaagcggtgaaaccgtggtgctgggtgggctgctggatgagtccgccaaagagcaggtctccaaggtgccgctgctgggggacattccgcttataggccagctgttccgctatacctccaccgacagcgccaaacgcaatctgatggtctttatccgcccgaccattattcgcgatgatgaggtgtaccgttcgctgtcgaaagacaaatacacccgctaccgcgatatgcaaaagcagcgtatcgataagtccaccagcgcgttgatcaaagtcgatgatgacgagcgcccgatgctgaaagagatggatgaggatctggcgcccgcgcccggcccgtcagcacgcaatcctttcagggaatagggggttcgcaacatggctgatttatggaaacgcatcccgccaggacaaccgctgccggtgagctatgcgcaggtgcaaaaacagggcgtggcagtggccggcgatcaactggtctgccgtaccgatacgccgctggaaatcttactggaagcccgctacgccctgcccgaccgtgtccgattcacgcgtctggagcctgcacagtttgaggactatctggagccgctgttccgcaacggcaccggggactcgcggcagattgccgaagatctcgatcaggatgtcgatctggcgacgctgagcgaagagctgccggataatgcggacttgcttagcgatgaaaatgacgcgccggtgatccgcctgatcaacgccattcttcacgaggcggtaaaagaaggcgcgtcggatattcatatcgaaaccttcgagaaatcgctggtggtgcgctttcgcgttgacggcatcctgaagccggtgttgcagccgggcaaaaaactcgcgccgctgctgatttcacgtattaaagtgatggcgcgtctggatattgcggaaaaacgcctgccgcaggacggccgcatctccctgcgcctcgggcgtaaaaatatcgatgtgcgtgtctcgacgctgccctcgcagtacggcgagcgcgccgtgctgcgcctgctggataaaaacaatttacggctgtcgctggacacgatggggctgaccgccggcgatgcgcagcgcctgcattttctggtgcggcagccgcacggcatcatcctggtgaccggcccgaccggttcgggtaaaagcaccacgctgtacgcggtgctttctgagctgaactccccccagcgcaatatcctgaccgtggaagatcctattgaatacgagctggaaggcatcggccagacgcaggtgaacagccgcgtggacatgtcttttgcccgcggcttacgcgccattctgcgtcaggatccggacgtggtgatggtgggtgagatccgcgatatggaaaccgcgcagattgcggtgcaggcctccctgaccggccacctggtcttatcgacgctgcacactaacagcgcctgcggggcgatcacgcgcctgcgcgatatgggcgtggagccgtttctgctgtcgtcctccctctccggcgtgattgcccagcgtctggtgcgccggttgtgcccttcctgtcgcacgcaaaccgccctgcccggggagctaaaagccctgttgcgtaccctcgccccggatgccacccattgctggcaggcggtgggctgtagcgactgtcggggttcaggttaccaggggcgactggcgatccacgagatcatggtagtggataagcatatgcgcagcattattcatcgtgatgccgacgaacatgcgctggagcagtgcctgcgccagcaaagccgcagcctgcgggaaaacggtctgctgcgcgcccttgccggtgaaacgaccattgaagaagtcatgcgcgtcacctcagcgcaggaagaactgcaatgaaatttcagtggcaggcaatggatgccagcggcgtgacccgccatggaactttaagcgcggccagcagtaaagaggcccgtgacacgctgcgcgctcaggggctttacccgttgacgctgcgggaaaaaaagtcggtgtcatggtttacccccccgacaaaaaccgcgcggctgcggctgagcggcaacgaactggcgctttttacccgccagctggccaccctcgccagcgcctccctgccgctggaggaagcgctggccgttattggccgtcagaaccagaacagcaagctcaaccatatcctgaccgatctgcgcgagcatattctcgccgggcacacgctttccgatgcgctggccgcctggccgcgtattttcgacaccatttaccgcacgctggtcaaagccggcgaaaaaagcggccagctcggcacggtgctggaaaaactcgcggactataacgagctgcggcaaaaaatgcgcagtaagctcatccaggcgctggtgtatcccaccatgctgaccagcgtcgcggtgatcgtggtgaccattttgctgaccacggtggtacctaaagtcgtggagcagtttctgcatatgaaacagcagttaccgctgtccacgcgcgcactccttacgatcagcgatgcgcttcgcgattttggcccctttttgctggcggcgctggtggtcgcgctgctgttattccgccactggcttaccagacccggcaaacgtcatcagttcgaccgctggctgctggctttccggctcagccgggggctactgcgcgccgtgcactgcgcccgttatctgtacaccttaagcattttgcataccagcggcgtgccgctgctggaaggtatgagtctgtcggcagagggcattaacaatcgtgagatccaggcccgactgcgcgacgccgccgaccgtgtgcgtcagggatcgggttttcacctggcgctggataaatgcgatctctttccgccgatgatgctctatatgatcgcctccggcgagaagagtggccagctcagcgagctgatggcccgcgccgccgaacagcaggaaaccttattgcaaaaccgcatcgcgctggcgctggcactgtttgagccagggctgattatcaccatggcgatgattgtactgttcattatcgtctcggtgttgcaaccaatcttacaactcaattcattagtgacttaaggaaaagcaatatgaacacagagtctcagaaacggcagcaggggtttaccctgctcgaactgatggtagttatcgttattcttggcgtgctggcaagcctggtggtgcctaacttaatgggtaataaagagcgcgccgataagcagaaagccatcagcgacattgtggcgctggaaaacgcgctggatatgtacaagctcgacaaccatcgctacccggtaacggctcaggggctgaaagcgctggttgaaaagcccaccagctcgccgatcccggaaaattacaacacctccggctatatcaaacgcctgccgcaggatccctggggaaatgattatctgctggtcagccctggcgagcacggggattacgacattatctctgcgggcgttgacggtgaagcgggcacccaggatgacattaataactgggaaatggataaagcgaagccctgaccatgaaggcggtaaaaggatttaccctgctggaaatattactggtgctgacgctgctggcgttaagcgccacgctggtgatgatggtgagcgacgacgatcgcaaaaaagccatcaccgccggtgagcaactggcggcgctgatggaatacaccgctgactggtcaaccatggaagaccgcagcgcgggtattgagatccgtgaacggggctggcgcattgtgacgccagtacgtaaccgctggcagccccctgaaaactatttccggctggcgaccgaaggcgactggcacgacagctggcgggtcacgctctcgcccgcctctctggccagacaggccgccgggacgccgcaaatccttatccgtccggacggcgaaatcacgccctttacgctgcaaatccaggatcggcaaagccaggcagtactctttactctgaccagcaccggcggcctgccgttgcaattcagcagtggagcaacaccatgagccgccagcagtccggcatgaccctgctggaagtgctgttggcgctggtgatcttcgcctccgtctcgctgacgctgatcaacagcctgagcgggcaaatcgccgccacctccaagatggaagagcaggtgttcgccagttgggttgccgataatgtgctgaaaaagcagcagctatccgccacaccgctggccgcaaccgcgcagggtaaaagccagatgggccaacgaagctggacatggacgctaacggcgtcggcatcggacgtgccgggtatgcagctattaacggcggaagtttctattgataacgggcagaaaatgcggctccgccgctatgtgcccgcagagaaaggagccgccgatgccccgacacgctaaagcacagaccggcttcacgctgctggaagtgctgctggcgattgcgctctttgcggtgctcagcctgctcaccggccagttactgagggcaacggtaaacagcaatgaggtgacgaaacagcatcagcaacgttttgcgaccctggttcgcgcggtcaatctgctggataaagatgtctggcagatcgtgccgctgatgccgccggagggcgaaaaaagccgtctgatgctcaccaccgccagcaacaatgacatgccggacatctgctgcgcgccggatctgcagcgcgtagagtggtcgcttaaaaatcactccctttaccgcgccatctggcgctatccggaggatgagcagccgtccatcacgcagcccatgttgacggacgtgaacgcctttaccctgcgttattaccttaaggatgccgtggtgaccacgcttccgcccggggaatacccgagggcgattgaagccgaaatcaatatcaacgggtcaggcacgatcacgcgcctgcttctgctgccggaaaaccgccgcaacggaggcacgccatgagatcgcaaaaaggcgtggcgctgctggtggtgttgatgatcctggcaatcatggccgcgctggccagtgaaatgacgctgcgctatcagatcaatatcaagcgcaccggttatacgcggcaacagttgcagcagaactggctgctaggactggctgagcatcaggcgatgctgacgcttgcgcaggatctgcgcgataacgccaaactgctgacgcgcgatcagctgtgggcgcagccacagcggctgtcgcttgccagcggcgagaccatcaactggcaactgactgaccgccaggcctgctttaacatcaatgcgctggtgaatgcgcccactgacatcatggcggacgtgcccgccagcgtacaggtctttaccgccctgctcgccaatcttggcgtgaccggcgcaccagccgaagcgcttatcgacgccattgctgattatatcgacagcgatgaaacgccgcgccgtgccggtgcggaaaacgactattaccgcaccagtggcgatccccataccatcggcggacgccgcctgtattcggtaagcgaactccgtcagatcaaaggtatgacgcctgcgctgtaccagcagctcatcccttttacgtgtgcgctgccgaacgatgagctgaagatcaacatcagcactctgacgcgtaaagatgcgcctctgctggcggcgatgctgaataacgccgtgcaggtcagcgacattcgcgccctgtttgataaacagaagcgtcagggctggacgagcattgccgcgctgaaagcatccatcgaaaaatcctttccgggacgcaaggaagaactggaggcgtttaaaaatatcgctgccaccaccagccagtatttccggctggaaaccatcgtggatcagggggagagccgcagcggcacgatcagcgatctggaatttgatacgaaaaagtcgcaactctttatcaccgcccgccgacgcgcggcggtcgggcattaaaaggatttacctcgtgcagaaaattatcttacgccctttaccaggaaaactggtgtggtgcattgccggtgaaacacccgcgccgacgcttcacgaactggaggactatcttcagccgggcgcgctggcgcatctgccgcccgccgataccgtctgcctgttgctgtcgccggaatacctctgttttcgccgcgccgaacttcctgctgcaaattacaaaattacgccgcaaaccctgagctggctggtggaagacagcgtaaccggcaacgccgacgatctgctgtggacggtactctgccgggaagagaatacgctgcatctggcggggatcgcccggcgcgccctcgcggagatgctggcggcgttctcggtggcgggcgtgacgctcacccatatggtgccggatggtttctggctgcctcatgtggcgaacggctggagtctgagtcaggaggcgtcgcggtggatgatccgttacgacgcctggaaaacgggcgtgctggacgaggcgctgctaggtcatttgctcagctcctgcccggagatgcctgtcgtgagcgccagcccatttccggtggagcacaccgcggttgaatatattcaggagcccggacactggtacgacgctgacaccctgcctgcggttaacctcattcagggcgcgtttcgcccggcccggcctgtgagacaggcgccacgcgcgctgaaatatggcgcagcggtaatgacaggcctggcaatggcgctctttttcggtctgaaagggctgacgctctggcagttgcatcagcaaaaacaggcgctggtatccgaaggacggacgctgtggagccgctattttcccggcgaggatcgcagtaataacttcaaatttttcttcgcctcctccgttaaaaaccgtcatccggacgtgctgacgttgctgacgcagcttcaggaaaagttacagccctggccggggctgacgctaagccatgtcagttacgatctcgatactcaccgttttgaggcgatcctcaacgcgaacgatgccggacagctcagcggatttatggcccaggccgccggtgaatataccgttctgcaacaaccggacggtgtgaagatcagcttaaaggagcgcaaatgaattctttctggcaatcaagaagcgctggcgaaaaacgcagcctgatgctgctcgcgctgttcagcctgctgctggcgttctggtacggcgtactacagccgctgaacaaagccatcctgcaacaacagcaggaatacgcccggctgaaaagcgagatccagtgggtgagcgaggccgcacagcgcagcggactggtgggcagccagctgctgaccggtgacgtcccgacgctgatacagcacagcgcggcgcaggcgggtctgaacgtggtggtgacgccagccacgcccggtcgttttaccgtcgcgctttccgctgccagcagcagcgcatttttcagctggctggatgagatgcaaaaccggggtttgcaggtatctcgattagcgttcagcgcaggcagcgcgccggacagcatcaccattgcaacactcgaattcgctcaggcaggcacgcatgattaacgaaacgtacgtcgcaatgctggcgctggtagggttacttaccggcagcgttatgaatgtggtggtttaccgtctgccgctgatgatggagaacgactgcccggcaaactggcatatcgcctggccgccctcgcactgcccgcattgtcagcaccgcataaggtacgtggataacattccgctgctcggctggctgttgctgcatggccgctgccgggactgccggcagcccatctccgctcgctatcctctgaccgaactgacctgcggcgtcgctttcgcgctgattgccgcgctgttcccggaccatgccgatgcctttgccgtgatgctgctgttctggtttgtactggcgctggcgcaaatcgatgcccgcacgtacttgctgccggaccggctgacgcagccgttgatctggctcggtatgctttatcatgcgctgtatcagcagaacaccttaacggatgggctgttcggcgcggtggcaggctacctttcgctgtggctggtgtggtggatataccggctgataaccggtaaagaagggctgggacttggggatgcgaaattgctgggggcgctgggagcctggagtggctggcaggcgttaccgacggtgctgctgggcgcgtcactgatggggattgtctgctggatggcgctgcgcctgacgcggggtacgcaggttccacaaatcgccttcggtccctggctggggctggcgggatgggttattttcagcgcacagttgttggggtgggaaatatactgaagcagagcggcgaactgtcgccgctctgtggataatgcttactcttcgcggatctgggcctgcaggtaattctgaatgcccattttctggatgagatccagttccgtttccagccagtcgatatgcccttcttcatcggccagaatttcaatcatcatgtcacggctgacatagtcatgaacgctgtccgcccaggcaatggcttcgcgcagatccttcgccccatctaattcaagcgcaagatcggaacgcagcatctcttcaacatcttcaccaatgttgagtttgcccaggtcctggagattggggatcccttcaaggaacaaaatacgctcaatatatttatcggcgtgtttcatttcatcaatggattcatggtattcgacgtcattaagacgtttgaggccccagtttttaaacatgcgtgcatgtaagaaatactggttgattgcgacaagctcgtttcccaataatttattgagataatttattatcttaacatcacctttcattttatcgttcctccgcttccactacctacaagcgtagtagaacgtcgaaaaattgcgctatgcaaacggctgagcctgcggttaagcaggctctggttgttaagacttatactcttatttttgcagcatctgaggtgtgaccgtcatgcttgtcagcaccttcaggcgggcagaatcgggttgagagccatctgcaagcgcaaagacatattcatcgcccgcttttggattctcactggtagcgcttaagtatcgattattgcgcaagtcccctagcatggccgccgaggtccccgtattgacttgatccattttgtaaaacgatcctacgaaagtcgatcccgtcaccttaccagtttgatctttatgatcgatatacatgttgagatattgccgactatggacgaggcttatgtcagcgatcacactatattccagtttgccgttgatatttttaatgtaggtatcaacgatatcgctgctctccgctgtattcagttgttcctgagtcacctccagagaggcgtaaacattgctcgggtcattatcatcaacgagttttgccactactcctggctcagtgaatacccctgtattcaggcagaaaacaaccgtatcgctatcgggtttattctcactctcacagtaattcttactccctttcacgttaatgatagcgacatagttactgtgatcggtcggggtcggcatcgtgaatcgcagttttttattttcataaaaatcgcggctcattgtccatttgaaccctgcatctgcactgtttggaataacccggcccaactgaaaatgagtaatgttcggagcgacgtcctccttaatgacatcggcgacaatgttgcccagctcgtgcgtttcagtatcgccgctcagatcccagacgatagcgccaccaaattgctgctgcttaatgtaattaactttctcgcgcaccgactgaggatcgtcataggtaaaaaactctttggttttgctgctatacagataaggcaccatcgcttccggatcccagtaacgcgtataatcgccgctggctaacatctctttcaggcgataccaggggttagtacccgtaaactgaccatcatcatcccacgcgccatgaacagtcgcggtacccggtgcaaacagacccggcaggcctttcactatttcggtcggctccacgttgccccagccgcgtccataccaggggatacccatcatcagtttattctttggcacttgccaggtagtggcatattccgtcattgcagacgcggtattgaatttctgatcttcatctttgctgttggcatgaagcggcgcgttatgaccggtgatcggatcgaatgagccgtggaagtcataggccataacgttgacagaatcgagcagcgccgtgttttccgccagattgatatactgcatcttactgtggctggcggtaacagctgcggaaagctgataatatttatcatctttaatgccctgatcgtcgagtttgctgcgcaacgacttaatcagtttagtaaactggcttttatccgcttcggtatccggatattcccagtcaacatccaccccgtcaaagccccaggtcagcatataattgacaatgctattagccagcttctcgacaccagcatccgtggcggtcgcggtttcaaattctccttccagcgagttattccagcccccgacagaaataatattggtgacgcctgcggcttcggtacgcttatccagatctctcatcagaccgggaccttgctcagtatcatgggtgatgacttcaccatttttcacaataccaaagccgtaattcaggtgggtgatcttactgtaatcaattttgtccggcgtaaaattacggtgcgcgtcatagacaccccattccgggaaatagccgtaaattttacgttgtccggcaactttcgctttctgttcgttttggaaatcaatcgccgcctgaccggtataaggcgtaaagtcgaatatacccagcgtttggatatttatctcagtacctctctcccagacgctgtcaacacccggatattcaccaggatttacccaccacttactggtccagtagtggttgtcatagcgaacaactgttccggtcgtcgggtaagactggctcggatcgtatattggcgtctcaatgaccttatcgtcttttaccgcgacggtaacggtcacattgcccggaaagttatcttgattttcattctggtaagcaatccaggtggcgccgttgtctttcgaaagcatctgactggcatccaggcctgtgatggtattagtctgatcgttagcgattaatgttgcagccgatgctgcaaatgggaaacccactgttgcaagcaacagtgcgcccataattttattaaggtgcataataagttcctttaatattgttgtccgttctgtcgattcattgaaaacagtgatagtgatatacagagtcagacgcaatgaagtagtgccagcagttacacttttcactatcagcaacgttatagcactcccgaagcaacgggcctacaaaataggcctgcaataccagcaaataggaaattagcccggaatttattcttaaaaacaataaaaagcattattcagcaagaaatgacatataatttatttttcggatgaaatattaacgaaatgggaaattatataaattaagcaacaaaaagaatttttaatttactaaatgtaatgtccaaataagttatttcttattagaacggtaatacgattgcaggggataagagaaaggctaaacagagggacatagcacgacgctgtctgcagacggtaatttgcaacaggcagcttcgcagtagtgacaggaactcaggcgatttctttaaactcaggttgcttcatcagctcatcttccatgatttcacgcgccgcacgtacgcacttcccgcactgattgccaaccggtatgaacttcctcaattgctgaaatgactgaggactaaactggcgtaccgcctgacggatctttttatcgctcacgccattacacagacaaatgtacatatgcactcccgttcaaaatctacccagattgtaaatgagaatggttatgatttcaatgccagaaaagagggtggtatggaacagggcacaacgtaaaaaagccgcctgcaagcaggcggcataacattttatacaagctgttatttcagcatatcggcagtaacgacaatttttgcaatggtcgccggattcggggaggtacgctcaaccaccacagtttcgcctacggagatatcccgctcatctgatttcacaaccatagtgtcgcccttatcactgacggaactgtaaaaacaggaaccattgtcgcaactgaaaatgtaattcccttttttcttgtcatcatcgataactttcgcaatataagatgagccgtcggcactcttcagcttatcttttgcaaactcgacaagaacgtagggaatattattttcctggataactttcaaggatttaacgtcgccgtcgttaacaaccggattatttccttgcagcatatcttcggtaacgatcagctcgccgatgacggctgggttaggctgagtacgtttaacagtgattttggccccggggtgcaggatataagccgcattacctgtgcgtaaagacacctctttaccgtagttgtagcgatatgagtagtaagctgttgccccttccgtggagaagagatactgcccgtcaacttccacacggtaggcattaccaggagacaacttagacgcatcgaggttgataacgacacgctgttgattatcaaacagggtgacaaacaaccctttcagatccggatcacgcgcaggcgtcgtgatgatctctttcacaatgttgcccagttcatgctccggcgtatcgccgctcagatcccagacaatagcgccgccgtagccttcctgattgatgtaatcaactttttcccggattgactgcggatcgtcgtaagtcaaaaactctttagttgcactattgtacaaataaggcactcgcgattcaggatcccaataacgggtatactgaccgttattcaccagacctttcaggtaataccatgggttggtaccagtgtactgtccgttgtcatcccactggccatgtatagtagccgtgcccggcgcaaacaaccctggcaaccccttcacaatttcggtgggttccacgttgccccaaccacgtccataccaggccagtcccatcatcagtttagatttaggcactttccaggtggtgctgtaggcggtcattgccgatgctgagttgaattccagatcggcatccttgctgttggcgaacaacggtgagttgtggccagtgatcggatcaaatgcgctatggaagtcataagacatgacgttaaccgaatcaagcagcggtaccgtctcagccggattgatatactggatcttattgtggtttgccgttaccgcggcagaaagctgatagtagcgatcttcttttacaccctcggcgtccagtttagtgcgcagggacttaatcagcctggtgaactgggttttctcggcgtcggtatccgggtactcccagtcgatatcaacgccatcaaatccccaggtcatcatgtaagagacaatgctgttagccagcttttcgatacctgcatcagtggcggttgcagcttcaaactggccctcttcggagttgttccaaccacccacggagagaatattggttacgcccgccagctccgtgcgctgatccagctcgcgcatcaaaccaggccctttttcggtgtcatgtgtcactacaacgccctgcttaaccaccgcaaagccataattcaggtgcgtaatgccagtataatcaattttatccggggtaaagttcttatgcgcgtcatacacgccccactccgggaagtaaccatagacttttcgttgtgcagccactttccctttttgctcattctgaaaatccacggctgcctggccggtataaggcgtgaaggtaaaggtcgccagagtattgattttcacttccttaccctgcagccatacgctattgctgccgggcatttcacctggatttacccaccactggctggtccagtaataaccattgtaacgaaccaccgtgcctgctgtagggtaagactgggatggatcataggtctgagaattaattaccttgtcgtcttttacggccaccatgaccacgacattacccgggaagttattctgattctcggtgctgtacgccagccaggtatttccattgtccttagataacatctggctggcgtcaagtccgctaatggtattcgtttgatcgttcgcggttagtgtacccgcagatgcggcgaagggggtacatgccagcgccattaatagcgccagggtatgctttttaaaatgcatggtaaaatccctctttaatatattcatgaaactcatacttaatactttttggtgaaagtagtaataaaaaattcaggacctcatactctcacttttattgtttcagtgtttactcaagggatcaattaacctttcctttaaaattaagatattaataataaatattaaggttttccttaatttgatatttgcgatatttatcattttcgcctaagcgttaacgcacacaataaaagcatcagctggaagaatagtttatttattacaaaagaaaataatatacaaaaatttgattatttatattaagcgccgttgttaaacgcgccgtaaagggatgagagggattaaaacagccaataaacaggaaaaaaaaatgccagccacataagtggctggcattcatgtcacattaaccccgaaaggttaagttcagcggcaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctcaacgccttccggcagttcgatggtgccagtcacgtcagttgtacggaagtagaactgcggacggtagcctttgaagaacggagtatgacggccgccttcatctttggacaggatgtaaacttcagatt

SEQ ID NO: 9 - DNA, 27221 bp, Enterobacter sp SA187
gcgtatattacgctttcctctttcagagtcaaccctcaatttcaggattttttctcttcaaccgaaccggctgtttgtgtgaagtgattcacatccgccgtgtcgatggaggcgcattatagggagttctgaaggcaccgcaatacctaaatgacagaaaaatgactgactgctgcattccacagcaaaaccccgccttatacccatttacgcacagagttatccacaaagcggtgaaacgctaaaaattcgcgagcgttgcgcaaacgttttcgttacaatgcccgcgctaaaacaaggatgccccgtctggggcgttagctgaattttaggaagaaagaaaaccgaaaattcagctaacgctctctgtaatgtccaaatcctggggatttaataccatgcaacaacgtcgtccagtccgccgcgctctgctcagtgtttctgacaaagcgggtatcatcgaatttgcacaggccctctcctcgcgtggcgtggagctgctatccaccggcggtaccgcacgcctgctggcagagaaaggcctgccggtcaccgaagtatccgactacaccggcttcccggaaatgatggatggacgcgtcaaaacgctgcacccgaaagtgcacggcggtattctgggtcgtcgcggacaagatgatgaaatcatggcgcagcacgacatctctccaatcgatatggttgttgtgaacctttacccgttcgccgccaccgtcgcacgcgagggctgcacgctggaagacgcggtagagaacattgatattggcggcccgaccatggtgcgctctgctgccaagaaccataaagacgtggctatcgtggttaagagcagcgactatcacgccattattaatgagatggatgctaacgacggctctctgacccttgctacccgttttgacctcgccattaaagccttcgaacacactgccgcctacgacagcatgatcgccaactacttcggcagcctggtccctgcttatcacggcgacagcaaagatcctgctggccgcttcccgcgcaccctgaatctgaacttcattaagaagcaggatatgcgctacggtgagaacagccaccagcaggccgccttctatatagaagaagaaattaaagaagcctcggttgccactgccactcaggtacagggcaaggcactctcttataacaacatcgccgataccgatgctgcgctggaatgtgtgaaagagttcagcgaaccggcctgtgtgatcgttaaacatgctaacccgtgcggcgtggcggtcagcgattcgatcctcgacgcttacgatcgtgcgtataaaaccgacccgacctccgcgttcggcggcatcatcgcctttaaccgcgagctggatgcggaaacggcgcaggccattatttcccgccagtttgttgaagtgatcatcgccccgtcagccactgaagaagcgctgaaaattaccgccgccaaacagaacgtgcgcgtgctggtttgcggcgaatggtctgcccgcgtcgcaggtctggatttcaaacgtgtgaatggcggtctgctggtacaggatcgcgatctgggcatggtgagcgaagcagagttgcgcgtggtcagcaaacgccagccgagcgagcaggaactgcgtgacgcgctgttctgctggaaagtcgccaagttcgttaagtccaacgccattgtctatgccagagagaatatgaccatcggcattggcgcgggtcagatgagccgcgtgtactccgcgaaaatcgccggtattaaagcaggtgatgaaggactggaagtgaaaggctccgcgatggcctctgacgccttcttcccgttccgcgatggtattgatgccgctgcggccgtaggcgtaagctgcgtgatccagcctggcggttccattcgtgatgatgaagtgattgcggcggccgacgaacacggtatcgccatgatcttcaccgacatgcgccacttccgccactaatcccggagcagataatgaaagtattagttattggtaatggcggacgcgagcacgcgctggcgtggaaagccgcccaatcacctttagtagaaaccgtttttgtcgcaccgggtaacgccggtacggcgctggagccgatgctgcaaaacgtggcgattggcgcgaccgatattccggcgctgttgaattttgcccaaagcgagcacattgacctgaccatcgttggcccggaagccccgctggtactgggcgtggtcgatgcttttcgcgcggccggcctgaccatctttggtccgacgcagggcgccgcccagctggaaggttccaaagctttcaccaaagacttcctcgcccgtcaccacattccgacggcggaataccagaactttaccgaggttgagcctgcgctggcgtatctgcgcgagaaaggcgcgccgattgttatcaaagcggacggtctggcggcaggtaaaggagtgattgtcgccatgacgctggaagaagcggaagccgcggttcaggatatgctggctggcaacgcctttggcgacgcggggcaccgtatcgtgattgaagagtttctggatggcgaagaagccagctttatcgtgatggtggatggcgaacacgtgttgccgatggccaccagccaggatcacaagcgcgttggcgatgccgataccgggccgaataccggcggtatgggcgcttactcgccggccccggtagtgactgatgaagttcaccagcgcactatggatcgcgtgatctggccaacggtgcgcggtatggcagcggaaggcaatacctacaccggcttcctgtacgccggtctgatgatcgacaagcagggcaacccgaaagtaatcgagtttaactgccgctttggcgatccggaaacccagccgatcatgctgcgcatgaagtccgatctggtcgaactgtgcctggcggcctgtgaaggcaaactggatgagaaaacctcggagtgggacgaacgcgcatcgctgggcgtggtgatcgccgcaggcggttatccgggtgattatcgtaccggtgatgtgatccacggcctgccgctggaagaagtaggcggtaaggtgttccatgcgggcacaacgcttgcggacgacgaccgtgtgctgactaacggcggccgcgtgctgtgcgccacggcgctgggacatacggtggcggaagcgcagaaaaacgcttatacgctgatggcagatattcactgggacggcagcttcagccgccgggatattggttatcgcgcgattgcccgcgagcaggggaagtaatttccccctcaccctaatcctctcccgcagggagaggaaacagatcgccctctctttcaggagagggtttactcagaaattcttttcctgcggctgccaggtacagtaatcctcattcgccaccagcagcagctgtgcgccttccggcgcttccagccatgcgacgctcacttccgccgaagaatggcgctgacgccgttctatatggcttaacgcctgctcatcgaattccggtttaactgtctgcccttcgcaggtactgacgctgtggtcggcatgccagcgcccctgacgcagtatcacctgcccctggcgcagcgcatcgctggtctggcggatctgatcggcacgatagcggtacagcgcgatctggtcgctggaaagctgttgcttctgaccgttcacttcccgctgcataaaactgagttcgccgtggtcatcaaaacgcacgcgaatatgttccggctgtttgccgtagatagtaagttcgataagggcaagggtatcgccctgccagcggtattcgctggttgaggtatctccgcttcgccacgggctgaaggcagagagaatatggacgtcgtcatcgacatctttacgccacaggcgtacggcaccctgatcgcctgcgtaaccgctggcggtaaagggcggcggtgacgagtcatggctacaggctgtcagcaataatgcgccagccagcgccagcggacggcaccagaatgacaaaaggggcgaaaacgccccctcgttaaaactgttcgctgccacgcggtcttacttaacggcgtctttcagtgctttaccagaaacaaatgccggcacgttagctgcggcgattttgatttctttaccggtctgcgggttgcggccagtacgctcagcgcggtggttcactttgaaggtaccgaaaccaaccagttgtacagcatcgccttctttcagagactcagtaatagcagccagggtggattccagagcagctttcgcctgcactttagacagatcagccttgtccgcaattacatcaatcagttgagtcttgttcataagttatccttacaatgtgtttatcgcttgctaagcatcgagtgcgacggaaatgccaaaaaagcgccctcctgcatacacgcaccgatagccactttttttcgccccccaaatgtagaccagacggggggctaatgggaagccttgcagtatgacaaatcaggcgttaaatcacgttttcttgtctcattgctgcaaatttataccgatattgctttcccccgcctcgcgcaggtccgcgcgcagacctttgatcagctcaaggtcgcgctcttcgcagtcggccagcaggcggaaaatctcccactgaatgtcccattcctgctcgacagccgggttaagttttagctcttcatcggtcatttcccgacctgcctgggtcatttccagcatcgctaccgtggtgatggaggttttgctgacttcaatagcatgctccagcgtatcgccgcttaacagcgaatgcagcatttcactcaatgccacacaggcatcgatagccggataaacgccatacatatcgtaatcgtccgccgacgggatcgcttcctccagcttttccagctggctgtcgaaattgatcttcgcgtctttaacggtcagcgtttcccagacgagatcgaccatacggcgatagagttgtgcatcgccaaagccggtttgctggcagaacatggcgtagttcgggtacatgcgctcgcaaaggcaggccatgaaagtgacgtgctgccagctttccagcttctccagccgcaggtgaatcgggttttgtaacatgatgaattctcaatatcggaaattagccgcagtgtacctgaatcaggggtgaatttcctgccagcgcacaaaggccggacgacgcgaggcaacggcatccgcccagcgcgtcggctccggtaaacggtagcctttggtacagcgctgcacccaggccagcgcagtgtcctgactgacccgatggccggtggcgataaacagcgggttacagcgcgctttgctgcgccatacccacgccagatcctcacccttatcacgcagcggcgccagcgcgcctggctcgtcagacagcggctcaaacttaccgcacaggcgttttttcgccacgccgatggtcggcacatccaccagcagaccaaaatgactggccacgcccagacgacgtggatgcgaaatgccatgcccgtcgacgaacagcagatcgggtttttgcgacagcatatcccacgccgccagcagcgcaggatattcacgaaacgagaggaaaccaggaatatagggcatggtagtggcgatacgcgcgatctgatattcaaccagttcaagttccggatacgtcagcagtaccatcgccgcgcgtgttacttctccgccctgctcaaatcccacatctgccccgccgatcagtctcggcggatcggtaataaaacgatcttcccggcataccgaggaagccagttccagttgttgtgcgcgtaatgacgccagatccatacctgctccttattgatgatagggctgtgaaagacggtgtaccgcctccacaaaagcacctgcatgctccggaggaacatcctgatggataccgtgaccgaggttaaacacgtggccttccccctgaccaaagccagccaggatagtcgccacttcctcttcaatgcgtgcaggctgtgcataaagcatggacgggtccatgttgccctgcaacgcgactttatgaccgacgcgacgacgcgcatcggcaatatcgatagtccagtcgagacccagcgcatcgcagccggtttccgccatcgcttccagccactgaccgccgcctttggtaaagagcgttaccggcacgcggcggccttcgttttcacgcagcaggccatcgacaattttatgcatgtaatagagagagaattgctgataatcgcgcccggtcagcacgccgccccaggtatcgaaaatcatcaccgactgcgcgcccgcgcggatctgcgcgttgagatagagcgtgacgcttttcgccagcttatcgagcagcgcatgcaaggtcagcggctcggcgtacatcatttttttgatcagcgtaaaggctttgctgctgccgccttccaccatgtaggtcgccagcgtccacgggctgccggagaagccaatcagcggcacttcgcctttcagttcgcggcggatggtgcgcaccgcgttcatcacgtaacccagttcatcttccggatccggcaccggcagtttttcgacgtcggctttacaggtgatgggcgaggtaaaacgcgggccttcgccggcttcaaagtagaggcccagacccatcgcatcggggatggtcagaatgtccgaaaaaaggatcgccgcatcaagcgggaaacggcgcagcggttgcagggtgacttcgcacgccagctccgcatttttacacagcgacataaagtcaccggcttgcgcgcgggtggctttgtactccggcaagtagcggccagcctgtctcatcatccataccggggtgacatccaccggcaggcgctggagcgcgcgcaggtaacgatcgtttttcagttcggtcattttgcagttcctcaatgcgtcagaccgtcattgtaacatgtcactcatactctgcccgacacaaagccacggtgtcctcgatcaaacggcgcgcgactgtgcctggcggcggtaacaacggcagcgcatcatagcgataccagcctgcatccagcagttcgttagggtcgatgttgatttcaccgctgtcatactcggccataaaggcggtcatcagcgattgcgggaacggccagggttgcgaggtaacgtagcgcagatttttcacgcggatggcgctctcttccatgacttcgcgggccaccgcctgctccagcgtttcgcccacttcgacaaacccggccaaaacggtatagatgccgttacggtggcgcgtgtgctgggccagcaggattttgtcttcccggcggatggcgacaatgatgcacggcgcgatttgcgggtaataacgttcacgacagttgccgcacagcatcgcccactcgcttttactggtgtgcatggtgtgcccgcagtaaccgcaaaactggtgcgagcggtaaaactccgccagttgcacgccgcgcccggcgagctggaacagcccgacatcctgatccattaattgccgcacggatgacatatcctgacgacgattctgacgcaccagccacaccggctcgccctgccattcgccgatggttaaaccgcgctgacccacaagatcaaaatttcctgcctcgccatgtggtaattctccagcgggcagccataatttttgttcatggctgacaatccaccagccctgatcggttaattcgatgacacgttccataatctgttgcactaccttagcgacactggcatgttggtaacatcatttttacaaattttgggtaagtattttttaatcttaatattacggagttgatcatgctaaaccagctacaaagcctgacagagcgagtgggaggaagtaataaacttgtcgaccattggttacatgtccgtaagcatctgcttgttgcttattacgatctggtcggcattaaacctggcagagaatcctttacagaactcgatgaaaaagcgctggatgatttttgccatagcctggtcgattatctttccgctggtcattttagtatttatgaacgcattatcagcgaaatggaagggaccagcccacttttcgccgccacgcagatctatcctctgctggaagcgaacacgcagcagatcatgaattattatgattccagcctggaaaatgccattgatgacagcaactgcattgaattccagcatgcgctgtccggcattggcgaagcgctggcgcaacgctttacccttgaagatcaattgatcgttctggcgttcgacttcaacctttctgaaagcgccaacgacgaggcagtaaccaataacgagagagatatggctcgtcctgcttgagttctgcggcagtaacacgtaatttattttagctttcccgtataacgggaaattatttcttgtcggagtgccgcgtacgacagtaccggctgagaccgttaattcgggatccgcggaacctgatcaggttagtacctgcgaagggaacaagagttcatctgcatggcatcgctgcatccggcgatcgccctcttgcttcatccgtcattctgacaagccacgtccttacttttatggaatgagctatgtctgccactaaaccaacacgtcgccagcaacgcgaacacgcccagcgctttatcgatactctggaaggtactgtcttccccggctcccgacgcatctatattcagggttcacagccggacattcgcgtgcccatgcgtgaaattcagctcagcccgacgccagtcggcggcactaaagacgcgccacgttttgaagaaaacgaagcgatcccggtgtatgacacctccggtccgtacggcgatcccgccattactattaacgtccggcaggggctgaccaggctgcgaagcccgtggattgcagcgcgtggcgcgacggcaggccagtgcgtgacccagttgcactatgcccgccaggggattgtcacgccggagatggaatttatcgccatccgtgaaaacatgggccgcgagcgcattcgcgctgatgtcctgcgccagcagcatactggcgaaggctttggcgcgcgcctgccggaaaacatcacccctgaatttgtacgtgatgaagtggccgccgggcgcgccattattcccgccaacatcaaccaccccgaatccgagccgatgatcattggccgcaacttcctggtaaaagtaaacgccaatattggtaattcggcggtcagctcctccatcgaagaggaagtggaaaagctggtgtgggccacgcgttggggggctgacaccgtgatggatctctccaccggccgtaatattcatgaaacccgcgaatggatcctgcgcaacagcccggtccccatcggcacggtgccggtttatcaagcgctggagaaggtcaacggcattgcggaaaacttaagctgggaagtattccgcgaaacgctgctggagcaggcggaacagggcgtcgattacttcactattcacgccggtgtgctgctgcgttatgtgccgatgacggcaaaacgtctgacgggtatcgtttcccgtggcggctcgatcatggcgaaatggtgcctgtcccatcatcaggaaaatttcctttacgaacgtttccgcgacatctgcgaaatctgcgcggcctatgacgtctccctgtcgctgggggacggcctgcgtcccggctccattcaggacgctaacgacgaagcgcagtttgcggaactgcacacccttggcgagctgacgaaaatcgcctgggagtacgacgtgcaggtgatgattgaaggccccggccatgtgccgatgcatatgatccgccgcaatatgaccgaacagctggagcactgccacgaagcgcctttctacaccctcggcccgctgaccaccgatattgcgccgggctacgaccatttcacctccggcattggcgcggcgatgatcggctggtttggctgcgcgatgctctgttacgtaacgccaaaagagcacctcggcctgccgaacaaagaggacgtcaaacagggattaatcacctataagatcgccgctcacgccgccgatttagccaaaggccatcctggggcgcagatccgcgataacgccatgtccaaagcgcgctttgaattccgctgggaagatcagtttaacctcgcgctcgatcccttcaccgcccgcgcttatcacgatgagacgctgccgcaggagtccggcaaagtggcgcacttctgttcgatgtgcggcccgaaattctgctcgatgaagatcagccaggaagtgcgcgactttgcggcaaagcaggcggttgacgccggcatggcagataaatcgaacgacttccgcgcccggggcggcgaaatctatctccggcaggaggaggcgtaatgtaccagcctgattttccgccggtacccttccggctcggactttatcccgtggtggacagcgtgacctggatcgagcgtctgctcggcgccggggtgcgcactctgcaactgcgcatcaaggataagcgcgatgaggaggtggaagccgatgttatcgccgctatcgcccttggccgccgctatcaggcgcggctgttcattaacgattactggcggctggcgatcaaacatggcgcttacggcgtgcaccttgggcaggaggatttacaggacaccgatttggcggcgatccgcgcggcaggtttacgccttggcgtatcgacccatgacgatatggaaatcgacgtcgcgctggcggcaaaaccgtcctatatcgccctcggccatgtcttcccgacgcaaaccaaacagatgccttctgccccgcaggggctggcacagctggcgcagcatatcgcccggctgaaagattatccgacggtcgccatcggcggtatcagcactgaacgcgcgcctgcggtactggcgaccggcgtgggcagcatcgcggtggtcagcgccatcaccgctgccgatgactggcaggcggcaacccggcagttgctggatctggcgggggtgggcgatgaatgacaatgatttcatgcgctacagccgccagatcctgctggaagacatcgccattgacgggcagcaaaaattgcttgccagccgggtgctgattgtcgggcttggcgggctcggctctccggcggcgctgtatctggcggcggcaggcgtgggaacgctggcgctcgccgatgacgacgcggtgcacctcagtaatctgcaacggcagatcctcttcaccacagaggatattaatcgcccaaaatcacaggccgcggcgcagcgcttacagcagctcaatccggacactgaactgatcgccctgaatcagcgtttagcgggcgatgcgctgcatcaggaagtggcccgtgccgatgtggtgctggattgtagtgataacatgaccacccgtcaggcgattaatgccgcctgcgtggcgaacaatacgccgctcgtcagcgcaagcgcggtgggctttggcgggcagttgatggtgctgacgccgccctggacgcagggctgctatcgctgcctgtggccggatgacgttgagcctgaacgcaactgccgcactgctggcgtcatcgggccggtggtgggcgtgatgggcagcctgcaggcgctggaagccatcaagctgttaaccggcataacgcctgcgcaaggtgaactgcggctgttcgatgcccgcagccatcactggcgcaccatcacccttcagcgggcggcaaactgcccggcgtgcggaggtctgcatgcgcattctgtttaatgatgagccgatgcagtgcgccgacgcgctgaccgtcagcgccctgctgacgcagcttaatcagctgacgcctggcatggcgctggcgctcaatcagcacatccttccccgggatcgctgggatcaacaactgttgcaggacggcgatcggatcctgctttttcaggtcatcgccggaggctgatatgttacgcattgctgataaaacctttacttcgcacctttttaccgggacggggaaattcgcctcacccgcgctgatgatgaacgcgatacgcgcctccggtagccagctggtcaccctggcgatgaagcgcgtcgatttgcgccagcgcagcgatgacctgctggcgccgttgctggaggccggggtgacgctgttgcctaatacttccggggcaaagaatgccgaagaagccgtgtttgccgcacagctggcaagggaggcgctcggcacaaactggctgaagctggagatccacccggatccgcgttggctattgcccgatcccatcgaaaccctgaaagccgcggagattctggtaaagcagggctttatcgtgctgccctattgcagcgccgatccggtgttatgcaaacggctggaggaagcgggctgcgcggcggtaatgccgctgggcgcgcctatcggctccaatcaggggctggaaacccgcgcgatgctggaaatcatcatcgctcaggctggcgtgcccgtggtggtggatgccgggataggcgcccccagccatgcggcacaggcgctggaaatgggcgcggatgcggtgctggtgaataccgccattgccgtggctgacgatccggtgaaaatggctcatgcattccgcctcgccgttgaagccggcgtgctggcgcgtgaagcggtgccgggcgcccggcactccttcgcacaggccaccagcccgctgaccggttttctggaggcgcagccatgaataccttcactgaccgctggcggcagctggactgggatgacatccgcctgcgtattcacagtaaaaccgcccgggacgtcgaacgggcgctcagcgccacgcagctcacccgcgaggatatgatggcgctgctctcccccgccgccagcgcgtttctggagccgctggcgcaacgttcgcagcaactgacccgccagcgttttggcaacacggtcagtttctacgtgccgctgtatctgtcaaacctctgtgctaacgactgcacttactgcggcttttcgatgagcaaccgcattaagcgcaagacactcgacgacgatgagatcgcccgcgagtgcgccgccatccgtcagatgggctttgaacacattttgctggtgaccggcgagcatgaaaagaaaaccggtatggactatttccgccagcagatcccggcgattcgccgccagttcgcctcgctgcatatggaagtgcagccgctgtcgcaggcggagtatgcggagctgaaagcgctcggcctcgacggtgtgatggtgtatcaggagacttatcatgaaggggtttacgccaggcaccatctgaaaggcaaaaagcaggacttcttctggcggctggagaccccggaccggctgggccgcgcgggtatcgataaaatcgggcttggcgcattgatcggtttgtcggatgactggcgggtggactgctttatggtggcggagcatctgctgtggctgcaaaaacagtactggcagagccgctattccatctctttcccgcgactgcgcccctgcaccggcggtattgaacccgcctccatcatggacgaacgccaactggtacaaaccctgtgcgcgtttcgcctgttcgcgccggaggtggaactgtcgctgtcaacgcgggaatcgccctggttccgcgataacgtgatcccgctggcggtgaacaacgtgagtgcgttttcgaaaacgcagcccggcggctatgctgacgaccacccggaactggagcagttcgcgccccatgacgggcgtcgcccgcaagaggtggcaagcgcgctgatgcgtcgtggtttacaacccgtatggaaagactgggacagctggctggggcgcaatttgtaaccggtttcaccttaagcgggtttctttgtgatgcccgacacacaatcactgcaaagcggttgttgatccccgggggtgggataattatcagttatcccatctacatcgaggctaactatgaaaaacatcgttttatgctgtgctgccggtatgtccaccagcatgttggttcaacgtatgaaagatgcggcgcagaaaaaaggcgtcgaggtgaccatcaaagccgttccggtggcggagtttaaggacaatatcgcaaccgccgatattgtcctgctgggaccccaggtgaaatatgaactggccaagcttcaggcgcaggctgagccgctgggcaaaaaggtcgccgttatcgatatgatggattacggcatgatgaaaggtgatgtcgtactggaaaaagcccttaagctgctggagtgatcgcatggaagatttggaaactatcatcatggaattgctggttaacgcgggcgcagcacgcagcgaagcgttaacggcgctacagctggcgcgtcagggggattttgcaggcgctgaggccgcgatgacggagtcgcgggaatacgttaagcatgcccataaaatccagacgcagctgataggtcttgatgaaggtgaaggcaaattgccggtgaatctgatcaccgtgcattcgcaggatcatctgatgaacgccatggtgattcaggatctggccggcgatatgattgaactgtatcgccgtttaccgcctttgaattgattgctgtctgaagagcaaaaaaaaacccgccgaagcgggttttttattatcgggctgttaacgattactcgttgtcagaaccgcccaggcctgcgttcagcagttctgccaggctggcagacgcgtcttcagcagtcacctgcggtgcagccgggagttcacccgcagcacgacggcgcatacgatcctgatggtacgcgtaaccggtaccagccgggatcagacgacccacgataacgttctctttcagaccgcgcagttcgtcgcgtttgcccgcaacggctgcttcggtaagcacacgagtggtctcctggaacgatgccgcggagatgaaggactcggttgccagagacgctttggtgatacccagcagatcgcgagcataggtcgctgcgattttgccgttcgcttccagttcgcggttagcgatcttgacgcgagagtattcagcctgctcaccttcgaggaagtcagagcttcctgcgttctcgatggtggctttacgcagcatctgacgcacgataacttcgatgtgcttatcgttgatcttaacgccctgcagacggtaaacgtcctgtacttcgttggtgatataacgcgtaacggcgtgaacaccacgaagacgcagaatgtcgtgcggcgcttccggaccatccgaaaccacatcaccacgttctacacgttcaccttcaaacacgttgagctgacgccatttcggtatcatctcttcgtacggctcgctgccatcaaccggggtgataaccagacgacgtttccctttggtttctttaccgaaggaaatgatgccgctgatttcagccaggattgccggctctttcggacgacgtgcttcgaacaggtcagcaacacgcggcagaccaccggtgatgtctttagtaccgccggattccatcggaatacgcgccagggtgtcaccaccgctgatctgtacgccgtcttccagctgcacaatcgctttacctggcaggaagtactgagctggcatatcggtaccagggatcagaacatcgttaccgttggcatcaacgattttcagcgccggacgcagatctttaccgcccgcggtacgttctgcagaatccagaaccaccagcgaagacagaccggtcagttcgtcggtctgacgagtaatcgtctggccgtcgatcatatcggtgaagcggatataacccgctacttcggtgataaccggcatggtgtgcggatcccagtttgctacggtttcgccgcctgcaacctgctcgccatcacccttcgccatgaccgcaccgtaaggcactttatagctttctttggtacgaccgaattcgtcgatcagtttcagctcggtgttacgggaggtcaccaccagtttaccgctggagttcacaaccgatttcgcgttgctgagacggatgctacctttgtttttcacttggatgctggattcagcagccgcacgagatgccgcaccaccgatgtggaacgtacgcatcgtcagctgtgtacccggctcaccgatggactgtgccgcgataacgccgattgcttcacctttgttgatgatgtggccacgcgccaggtcacgaccatagcagtgtgcacatacaccaaagtcggtgtcacaggatacaacggaacgcactttcacgctgtctacggagttcgcttccagcaggtcacaccattgctcatgcagcagcgtgttgcgtggaaccagaatgtccgcggtacctggtttcagtacgtcttcagcggtcacacgacccagaacgcgatcgcgcagcggctctttaacatcaccaccctcgataaccggggtcatggtgataccttcgagggtgccacaatcgtcttcggtaaccaccagatcctgcgcaacgtcaaccagacgacgcgtcagataaccggagttcgcggttttcagtgcggtatccgccagacctttacgcgcaccgtgcgtggagatgaagtactggagtacgttcagaccttcacggaagttcgcggtgatcggcgtttcgatgatggagccatccggcttcgccatcagaccacgcatacctgccagctgacgaatctgtgccgcagaaccacgcgcaccggagtcggccatcatgtaaatgctgttgaaggaaacctgctgctcttcgacgccgtcacggttaataacggtttcggtttgcaggttgtccatcatcgctttagatacacgatcgttcgccgcagcccagatatcgataactttgttatagcgttcgcccgcagttaccagaccagactggaactgttcctgaatttcagcaacttccgcttccgcttcgctgatgatttcagttttcttctcagggatcaccatatcgtcgataccaacggatgcacctgaacgcgctgcataagcaaagccggtgtacatcgtctggtcagcaaagataacggtcggtttcaggcccagaatgcggtaacaggtgttcagcattttggagatcgctttcttgcccagcgcctggttgacgatggagaaaggcagacctttcggtacgatcatccacaggatcgcacgaccaatggtcgtatcaatcaggctggttttcgcaacgaattcgccctgtgcatctttttcatactcggtgatacgcacttttacacgcgcatgcagagaggccaggccagcgcgataaatacgctcagcttctttcgggccagtcagcaccatgccttcgcctttggcgttaacacagtcacgggtcatgtagtacagacccagtacaacgtcctgagacggaacgatgattggttcgccgttcgccggagacagaatgttgttggtagacatcatcagcgcacgcgcttccagctgagcttcaagcgtcagcggaacgtgtactgccatctggtcaccatcgaagtcggcgttataagccgcacaaaccagcgggtgcagctggattgctttaccttcgatcagtaccggttcaaatgcctggatacccaaacggtgcagtgttggtgcacggttcagcagtaccgggtgttcgcggataacttcgtccaggatatcccaaacgacagcttcttcacgctcaaccattttcttggcggctttgatggtggtagcaagaccacgcagttccagcttgccgtagatgaacggtttgaacagctccagcgccattttcttcggcagaccgcactgatgcagacgcaggtatggacctacggtgataacagaacgaccggagtagtcaacacgcttaccgagcaggttctgacggaaacgaccctgtttacctttgatcatatcggccaaagatttcagaggacgcttgttagaaccggtgatcgcacgaccgcgacgaccgttatccagcagggcatctactgcttcctgcagcatacgtttttcgttacgtacaatgatgtccggcgcagccagatccagcagacgtttcagacggttgttacggttgataacgcgacgatacagatcgttcagatccgacgttgcgaaacgaccaccatccagcggtaccagcggacgcagatctggcggcagaaccggcagaacggtcaggatcatccactctggcttgttgccagacatcacgaatgcttccagcagtttgatacgcttggtcagctttttacgcttggtttcggagttagtttcgttcagctcttcacgcagctgctcgcactctttctccagatccatgcttttcagcagggcctggatcgcttccgcacccattttcgcgtcgaattcgtcaccgaactcttccagcgcgtccagatactgttcttcggtcaggatctggttacgttccagattggtcataccgccttcgataaccacataggattcgaagtacagaacacgttcgatatcgcgcagcggcatatccagcagcaggccgatacgggacggcagagatttcaggaaccagatgtgcgcagtcggagaggccagttcgatgtggcccatgcgctcacggcgcactttggtctgggtcacttcaacgccgcacttctcacagatcacaccacggtgtttcaggcgcttgtacttaccgcacaggcactcatagtcttttactggcccgaaaatacgcgcacagaaaaggccgtcacgctcaggtttgaacgtacggtagttgatggtttccggcttcttaacttcaccgaaagaccatgaacggatcatgtctggcgaggccagcgcaattttgatcgcatcaaactcttcggttttagtctgcgctttcagaaactttaataaatctttcacggatttgctcccgtcggagttagcacaatctggcgccgggagtgaccccggcaccagtgacctgtttgagcgagagttactcgtcttccagttcgatgttgatacccagcgaacggatctctttcaacagtacgttgaaggattccggcatgcccggttccatctgatggttaccgtccacgatgtttttatacatcttggtacgaccattaacgtcatcagacttaacggtgagcatttcctgcagggtgtatgccgcgccatatgcttccagcgcccacacttccatctccccgaagcgctgaccaccgaactgcgccttaccacccagcggctgctgagtaaccaggctgtaagaaccggtagaacgcgcatgcattttgtcatcaaccaggtggttcagtttcagcatgtacatatagccgacggtaacctggcgctcgaattgctcaccagtacggccgtcgaacagggtaatctgaccggaagtcggcaggccacccagctgtaacagttccttgatttcagactctttcgcaccgtcgaataccggcgttgcgatcggcatacctttacgcaggttctcagccagacgcagaacttcttcatcagtgaaggtgttcaggtcaactttctgacgaacgtcggagcccagatcgtaagcacgctggatgaattcgcgcagtttcgcgacttcctgctgctgtttcagcatggcgttgatcttatcgccgatacctttagcagccatacccaggtgagtttccaggatctgaccgatgttcatacgagacggtacgcccagcgggttcagtacgatgtctaccggcgtgccgttttcatcgtaaggcatatcttcgatcgggttgatcttagagataacacccttgttaccgtgacgacccgccattttgtcaccaggctggatctgacgtttaacggccagatacactttaacgattttcagcacgcccggtgccaggtcatcgccctgagtgattttgcgacgtttcgcttcgagttttttctcgaactcgtgcttcagttcgtcatactgctcagccagctgttccagctgattttgtttgctttcgtcggtcagaccgagttccagccagcggtcgcgcggcagtttgtcgagcttctcagcttcaacgccaccggaaaccagcacggcatggatacggctgaacaggccagcttcgaggatctgcaattcttcagacaggtcttttttcgcctgcttcagctgcatctcttcgatttccagcgcacgtttgtctttttccacgccatcgcgggtaaagacctgaacgtcgataacggtaccggaaacgccgttcggcacacgcagagaagagtctttaacgtcagacgctttctcaccgaagatcgcacgcagcagtttttcttccggcgtcagctgggtttcacctttcggcgtcaccttgcccaccagaatgtcgccgccggtcacttctgcaccgatgtaaacgataccggattcatccagtttggagagcgctgcttcacccacgttcgggatgtcggcggtgatctcttccggccccagcttggtgtcacgggacacacatgccagttcctgaatatggatggtagtgaaacgatcttcctgaaccacacgctcggagacaaggatggagtcttcgaagttataaccattccacggcatgaaggctacgcgcatgttctgaccgagcgccagttcaccgaggtcggtggacggaccgtctgccagcacgtcgccgcgctcaattggctcacccagagatacgcaaggcatctggttgatgcaggtgttctggttagaacgggtgtatttggtcaggttataaatgtcgatacctgcttcgcccgggtacatctcgtcttcgttaactttgataacgatacgggaagcatccacgtactgaacagtaccgccacgcttagcaacagcagtaacaccggagtcaacggcaacagcacgttccataccagtaccaaccagcggcttatcagcgcgcagagtcggaacggcctgacgttgcatgttcgcacccatcaatgcacggttggcgtcatcgtgttccaggaacgggatcagggacgcaccgacggaaaccacctgctgggtggaaacgtccatgtagtcaacctggtcgttgctgaacaagctggattcgcctttgctacggcaggtaacgagatcgtcaacaaagcgaccttcttcatccaggttggtgttcgcctgagcgataacgtagttaccttcttcgatagcagaaaggtaatggatctcgtcagtcaccacgccgtcagtcactttacgatacggagtctcaaggaagccgtattcgttagtctgtgcataaacggacagggagttgatcagaccgatgttcggaccttcaggcgtttcgattggacatacgcgaccgtagtgagtcgggtgtacgtctcgaacttcaaagcctgcgcgctcacgggtcagaccgcccgggccgagtgcggagatacgacgcttgtgcgtgatctcagacagcgggttgttctggtccataaactgagacagctggctggaaccgaagaactctttcactgctgcggaaatcggcttggcgttgatcatatcctgaggcatcagggtatccagatcgcccagagacagacgctctttcaccgcacgctctacacgtaccagaccaacgcggaactggttttccgccatttcgccaacggaacggatacgacggttgccgaggtggtcgatatcgtccacttcgcctttaccgttacggataccgatgagcttcttcatcacttcaatgatgtcgtctttgctcaggataccggaaccttcgatttcgtcgcgcagcaaagaacggttgaacttcatacgaccaaccgcagacagatcatagcggtcttcggagaagaacaggttctcgaacaggctttcagccgcttcgcgcgtcggtggttcacctgggcgcatcatgcggtagatttcaaccagcgcgctcagacgatcgttggttgggtcgacacggatagtctcagaaatgtaagcgccgtgatccaggtcgttggtaaacagcgtttcgatacgcttatgaccggcctggctcagcttcgccagcagatccagagagagttccatgtttgctgcgcaaatcagctcgccagtagactcatcaacgtagtctttagcggcaactttgcctgcaatgtactcaaccgggacttcaatcagtttgatatcgtctttttccagctggcgaatgtgacgcgcggtaatacgacgcgctttttccacatacactttgccgttagcttcgatgtcgaaggaggcggtttcaccacgaaggcgttccggcaccagttccatctgcagcttgttatcacgaatttcaaagacgactttttcaaagaacaggtcaaggatctgctcagtggtgtaattcagtgcacgcaggatgatagtcgctggcagtttgcggcgacggtcaatacgtacgaacaggttgtctttcggatcgaactcgaagtccagccatgaaccgcggtaaggaatgatacgcgcgttatacagcactttacctgaagagtgagttttacctttgtcgctgtcaaagaatacgccaggactacggtgaagctgagacacgataacgcgctcagtaccgttaataacaaaggtaccgttgtcggtcatgagcggaatttcgcccatgtaaacttcttgctctttgatgtctttaacggtgccttccggcgcttcgcgctcgtagatcaccagacgcagtttcacacgcagcggtgccgagtaggtcacgccacggatctggcattcttttacatcaaagacaggctcgccaagacggtaactgacgtattgcagttccgagttgccgctgtagctcgtgatcgggaacacggaacggaatgctgcttccagaccgtactgcccttcaggatcttgctcgataaacttctggaacgagtcaagctggatagaaaggagatatggaatgtccagcacttgcggacgttttccaaaatccttacgaatacgttttttctcggtataggagtaaaccattagggttcctcagctcgctgacaagtcgacccatctgcccgacgaaagggacagtttgtgcaacactattttgttgaccggaaagtggggcactttccgcaatgcttgttgctatcacgcttaaaccatttcgttgcgatttacacaaagcgcgagccttgtcgcaatatattaagtcgtcgatagaaacaagcattgtgaggggaagccagtagttaaacagtgtgaaacactaccgacaccctacagcgcaaaaaggctggtgaccaaaaagtcaccagccatcagcctgatttctcaggctgcaaccggaagggttggcttatttaacttcaacttcagcgccagcttcttccagagattttttcagagcttcagcgtcatctttgctcacgccttctttcagagaggccggagcagattctaccaggtctttagcttctttcagacccaggccagttgcgccacgtactgctttgatcacagcaactttgttagcgccaacagctttcagaataacgtcgaattcagttttctcttcagcagcttcagccgggccagcagcaacagctacagcggcagcagcagaaacaccgaatttttcttccattgcagagatcagttctacaacgtccattacggacatagcggatactgcttcaatgatttgatctttagtgatagacatttaaattgttcctgaatatcagaataagtttatacgtaagcaaatgctttacaaagataactgcgattaagcagcttctttggcatcgcgtacagcagccagagtacgaaccagtttgccagccgaagcttctttcatggttgccatcaggcgtgcaattgcttcttcgtaagtcggcagagttgccaggcgatcgatctgcgacgccggaatcaactcaccttcaaaggcagcggctttgacctcaaattttgcattcgctttcgcgaattctttgaacagacgagcagcagcgcccgggtgttccatagaatatgcaatcagggtcggaccaacgaacgcgtctttcaggcactcgaactgagtaccttcaacaacacggcgcagcagggtgttacgaacaacacgcatgtatacgccggcttcgcgacctgctttacgcagttcggtcattttatctacggtaacgccacgggaatccgcaacaaccgcagacagcgcgcctttggctacttcgctgacttcagcaacaatcgcttgtttgtcttgaagatttaaagccattagctttgctcctggatgtttgccagggcttatgccctggaactcacttcactcttctcaaagaaaagagcgtcttaatacggtgagcagaaacaagccaaagatacttataaaatgtcttcaggttctgtcaccgtctacgcagggaattaagtttcttgcgaaacacctgcggtcttggacggaggcctggattaggccaggctccaaccgaaaatcttttcgtgggcgaagattgtagacaaatccaccgcccacgtaaaggcgaatattagttcgccaccgcagtcagaccagactggtcaactgcaacacctgcacccatggtggtggagatgctaactttcttgatgtacacgcctttcgcctgagtcggttttgcttttttcagcgcaaccagcagagattccaggttttctttcagtttgtcagcgtcaaagtccactttaccgatggtggtgtggatgatgccgtttttgtcgttacggtaacgaacctgacccgctttagcgttcttaaccgcttcagcaacgttcggcgttacagtaccaactttcgggtttggcatcaggccacgcggacccagaacctggcccagctggccaacaacgcgcattgcatccggggaagcaataacaacgtcaaagttcatttcgcctttcttgatctgttctgccagatcttccatacctaccagctcagcgccagcagctttagctgcttcagcgttcgggccctgggtaaatacagctacgcgaactgaacggccagtaccgtgcggcagtacagttgcaccacgtacgttctggtcagatttacgagcatcgatgccgaggttaacagcaacgtcaacgctttcgttgaatttagcggtggccagctctttcagcagagcgatggcttcgttgatgtcgtactgtttggtcgcatcaactttctcacggatcacgcgcatgcgcttggtcagtttagccatttcttaatcctccactaccaggcccatggaacgcgcggtaccttcgatggagcgagtcatcgcttcaacgtctgcaccagtcatgtccgcggctttagtctgcgcgatttcctgcagctgagcgcgggagatcttgcccactttgtctttgttcggcttgccggaaccagacttgataccagccgctttcttcagcagaactgctgccggaggcgttttggtaacgaaagtgaaagaacggtcagcgtaaacggtaataacaaccgggatcggcagacctttctccatggaatcagttttcgcgttaaacgctttacagaattccatgatgttaacaccctgttgacccagagccggacctactggcggactcgggtttgccatgccagctgcaacctgcagcttgacgtaggcctggactttcttagccattgcaatttcctcgtgtgggtatagcgccttaaaaaggctccccgtgattaatactgtgtcttacgggtacatgacccgtaaaaacaaaaggcgcgaaattgtatgtcaatttcgcgccctgtgcaacgatttaatcgccgcttttttggtcggcaggttaggccttctctacctgtgcaaaatccagttctaccggcgttgcacggccaaagatggaaacagataccttaagacgggacttctcgtagtccacttcttcaaccacaccgttaaagtctgcaaacggaccatcgctaacgcgaaccatttcacccggctcgaacagcgttttcggacgtggcttgtcgccaacttgctgcagacgattcatgatggcatcgacttctttgtcgctgatcggcgccggacgatcggacgtcccaccgataaagcccatcacgcgcggtacgctgcgcaccaggtgccagctcgcatcgttcatgaccatttgaaccagaacgtaacccgggaagaatttgcgctcgctcttacgacgttggccaccacggatttcgaccacttcttcggtcggcaccatgacttcgccaaacaactcttccatattgtgtaatttgatatgctcacgcagcgacgtagctacgcggccttcaaaaccggaaaacgcctgaacgacgtaccagcgctttttaggggcttcagacatctcagaacctcaggccagtgataaaggataccaggcgaaccagaataccatccagtccccacaggatcagtgacataacagcagtaactgctgccacaatcagcgtggtgtgcaatgtttcctggcgagttggccaaatcactttacggacttcggttctcgcttcacgggcaaaagcaacggtcgctttacccttcgtcgtcaacagcgcgacaccacccgctgcagcaattaaaataacgactgccagcgcgcgtaacggcagcatcatgtcacgataaaggtagttgccaacgatagccacgatcagcagcgcagcaacaacaacccacttcatcgcttccaggccgcgcccgctcccttgagcttcggtattcgcactcataaaccaacctgtcacaagaattcagacaaacatttttgccccgccatagcgaggcaaccaaaccgaaatgctctattgcgcttcggacttaacgccctctacagagcctgtctcagcaatgattatgacgtataaaatcactgatgagccaggttctggttcgaaagcgtacaaaaagggcatcaaatgatgcccttttaatgcgcattgcgtcaaatgttatcagcgattagccaagaactttagcaacaacgcctgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtgccagtcacgtcagttgtacggaagtagaactgcggacggtagcctttgaagaacggagtatgacggccgccttcatctttggacaggatgtaaacttcagatt

SEQ ID NO: 10 - DNA, 4596 bp, Enterobacter sp SA187
atttgcctggcggcactagcgcggcggtcccacctgaccccatgccgaactcagaagtgaaacgccgtagcgccgatggtagtgtggggtctccccatgcgagagtagggaactgccaggcatcaaacaaagcagaaggccattctcacggatggcctttttgcgtttggcgatctccctgacgccatcctccacacgactaaccacaagcgatcccgccatatatacggtaaactagccgtgtttttgtctctggatagcgtctatgaatcactcccttaagccctggaatacatttggtatagcgcgtcaggccgcacgcattgttcgtgcagagaatgagcaacagttactctctgcctggcaggaagcggtaaaaaatcagcgtccggttctgctactgggagaaggtagtaatgttcttttcctggaagactttgccggcaccgtcattgtgaaccgtattatgggcatcgaggcggtggaacgatcagatgcatggcatctgcacgtcggggcaggggaaaactggcataagtttgtccagtacacgctggataacggtatgcccgggcttgaaaaccttgcgctgatccccggctgtgtcggttcatctcctattcagaacattggcgcatacgggattgaactccagcgggtttgtgagtatgtcgactgtcttgagctcgagtccggtaaaaggctgcgtctgagcgctgcagagtgtcaattcggctatcgcgacagtgctttcaaacaccagtatcaggatcgttatgccatcgttgccgttggtttccgcctgtcaaaaacatggcagcctgtactgacctatggcgatttaacgcgccttgatccgcagagagtcacgcctctggatgtatttaattcggtgtgccacatgcgcatgacaaagcttccggatccaaaagtgaatggtaacgcaggcagctttttcaagaacccggttatcaccgctgagcaagcccaggcattgctggcgcagtttcctgccgccccgcactatcctcaggctgatggcagcgtgaagctggccgctggctggcttatcgatcagtgtgatttaaaaggaacgacgctgggcggcgcggctgtgcaccgtcagcaagctctggtgctgattaatactggcgacgccaccagtgacgatgtggtaaaactcgcccaccatgttcgccagcaggtcggtaataaatttagtgtctggctggagccggaagtgcgatttatcggccagacgggtgaagtaaatgcagtggagattatcgcgtgaaggacaataccattccattaactctgatctccattctggcagatggcgaatttcattctggcgaacagctgggtgaacatcttggcatgagcagggcggcgattaataagcatgtccagactttgcgtgactggggcgtagatgtctttaccgtgcctggtaaaggttacagtctgccagagccaatccagttgctggatgacgcatttatcagcgggcagtttaatgaggggaatattgccgttcttccggtaatagactcaacgaaccagtatctgatggatcgcatggatcaattacattctggtgatgcctgtgtggcggaatatcagcaggccggacgcggcagacgcggacggaagtggttttcacctttcggcgccaatctgtatctttccatgtactggcgtctggaacagggcccggctgccgctatggggctgagtctggttatcggtattgtcatggcagaggtattacaggcgctgggtgctgaagaggtgcgtgtaaaatggcccaacgatttataccttcaggacagaaagctcgcaggtattctggtggaactgaccggaaaaacgggggatgccgcacagatagttataggggcgggtattaacctcgccatgcgcaacgttgaagctgacattgtgaatcagggctggatcaacctccaggaggccgggatcgccgtggatcgcaatcagctggcagtacgcctcattagcgaactacgtgccgcactacacctgtttgaacaggaaggtttaagcccgtacctgatgcgctggaaaaagctggataactttattaaccggccggtgaagctaattatcggcgacaaagagatttacggtatttcccgcggtatcgacgctcagggggcattattacttgagcaggatggtattaccaagccatgggtcggtggcgaaatatcattaagaagtgccggataaaaaaaggagagcataatgctctcctttttgtttatttacgtaaacggacctgctctacggcgtgattggcgctcttggtcataatcagactggcgcgctcacgggtgggtagtatgttttcttttaaattcaacccgttaatctctttccacagggaggtggcaatattgaccgcttcttccgtcgatagtttggcatagttatggaaataagaatccgggttactaaaagccccttcacggaatttcaggaagcggttgatataccaggtctgtaataaatcttccggcgcatcaacataaatagagaagtcgacgaagtcagatacaaatacatgatgtggatcgtgtggataatccataccgctttgcagcacattcaaaccttcgagaataagaatatccggctgggttaccgtcttatcaccgtccgggatcacgtcatagatgaggtgtgaatatacgggcgcggtgacgttgggtacgcctgatttgagatccgagacaaatttcaccagccggtgcatatcataagaaagagggaaacccttcttcttcatcaacccgcgttctttcaacacttcattagggtggaggaagccatcggtggtaatcagctcaacgcggcgatgttcaggccagcggcttaacaacgcctgaagcacacgtgcagtggtgcttttacccacggctacgctgccggcaatactaatgatgtagggtatgcgttccccgttagtgcccagaaactgctccagtacggcctgacgacgcagattcgaactgatgtagaaattgagtaaacgtgacaacggcagataaatctctgcaacttcttccagagaaaggtcttcgttgatgccttttaaccgcgcgatttcaccttctgtcagggtcatcggcactgaatcacgaagggcagcccactggctgcggttaaactcaaggtaaggcgtcattaacgattgctcttttttactcataagcatatgtctgcctgccatgctcatttcccgctcaatcactgctgttcagtgagacaccgaatattcagaccgcgacaatggcacgctgcatgtaagttaaatttggacaatacgcaggagggtaacaccagatgaaaaggaataataagaaaaaatcacctcgacgggcggattcaaaggcgagcatcacgaaagcaggaatcaggtgagattgcgctataaaagagaagtacaaccttcgcacaggtaataagatagcgcgcggcgcacatagccttcttcaggctggcgaggatgatcggtttatgcgcggccttttcacctcacctacccctaacttgctgaataattgttctgctctgcatgaaattacagcatttttccatgctggcgcacaaaatgtgagcgatagaacgttttctgcgatttttttgttgcatgcaggcgcaggtctacctagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccactttctggcagcgtaaaaactgtctgggctggttgaaagactaaccggctcaagcgaaaaagagacatgtctctttttttgtcacagaaagaactgggtagccgagtttcaggatgcgggcatcgtataatggctattacctcagccttccaagctgatgatgcgggttcgattcccgctgcccgctccagacgtgctgatatggctcagttggtagagcgcacccttggtaagggtgaggtccccagttcgactctgggtatcagcaccacttcacttctccttcccgtttctctctgtgtaagcttaaatattcaacatttcaggcatatcgcctggttgatgtggtgatatcaccgatttatccgtgtcttagagggacaatcgatgtctaaagaaaagtttgaacgtacaaaaccgcacgttaacgtcggtactatcggccacgttgaccatggcaaaactacactgaccgctgcaatcactaccgttctggctaaaacctacggtggttctgctcgtgcattcgaccagatcgataacgcgccggaagaaaaagctcgtggtatcaccatcaacacttctcacgttgaatacgacaccccgactcgccactacgcacacgtagactgcccgggccacgccgactatgttaaaaacatgatcaccggtgctgctcagatggatggcgcaatcctggttgttgctgcga

SEQ ID NO: 11 - DNA, 2827 bp, Enterobacter sp SA187
gtcagggagaactcatctcggggcaagtttcgtgcttagatgctttcagcacttatctcttccgcatttagctaccgggcaatgccattggcatgacaacccgaacaccagtgatgcgtccactccggtcctctcgtactaggagcagcccccctcaattctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctagcttatgccattgcactaacctcctgatgtccgaccaggattagctaaccttcgtgctcctccgttacgctttaggaggagaccgccccagtcaaactacccaccagacactgtccgcaacccggattacgggtccacgttagaacaccagccattaaagggtggtatttcaaggatggctccacgcagactggcgtccacgcttcaaagcctcccacctatcctacacatcaaggaccagtgttcagtgtcaagctatagtaaaggttcacggggtctttccgtcttgccgcgggtacactgcatcttcacagcgatttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttgccgctaaccccatcaattaaccttccggcaccgggcaggcgtcacaccgtatacgtccactttcgtgtttgcacagtgctgtgtttttaataaacagttgcagccagctggtatcttcgactggtttcagctccgcgagcaagtcgcttcacctacgcaccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagcagggcatttgtcacttcagcaccgtagtgcctcgtcgtcacgcctcagtgttaaagtgaaccggatttacctggaacacacacctacacgcttaaaccgggacaaccgtcgcccggccaacatagccttctccgtccccccttcgcagtaacaccgagtacaggaatattaacctgtttcccatcgactacgcctttcggcctcgccttaggggtcgactcaccctgccccgattaacgttggacaggaacccttggtcttccggcgagcgggtttttcacccgctttatcgttacttatgtcagcattcgcacttctgatacctccagcagacctcacagtccaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagtcgggatgaccccctagccgaaacagtgctctacccccgaagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctatacggttaaccttgctacagaatataagtcgctgacccattatacaaaaggtacgcagtcaccccataaagaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccctactcttcgaactcacaacatgtgcatttttgtgtacgggagtatcaccctgtaccctgcgactttccagacgcttccactaacacacatgctgattcaggttctgggctcctccccgttcgctcgccgctactgggggaatctcggttgatttcttttcctcggggtacttagatgtttcagttcccccggttcgcctcatgccactatgtattcatgacatgatagtgcaacggattgcactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttcacttctgattgc

SEQ ID NO: 12 - DNA, 1727 bp, Enterobacter sp SA187
tcggtttaggaaaagcagatggtgtgactttcacgaacctggatctgagtcttaaagggggtagctcaggcatcttgaccctgaaccagttagcaactgattcaaccttttccggtgggagtcggttttatcacgaaactcagtcaggagttcacaaaacgaccattcatacttattcagccggttattcgaaaaataattatgtccaaatatcggaagacggagatctcaccggaattcgtaactctaacggtctgaacttttttgcaggagagcgtggttttcgtggtaattgtcttcaaactggatggggtggggagggagatattctgaatgttcctttctttggaaatatagtaagaggtaatgatggcggttggtcaccaatagtatcaggtggttcaagtgctacgggcggttatcagactcataccgcattcggagcaattgcaaatggcgctactacatgggccagtgccgctataaagattttaggcgataacatttatcatagagcatttattttcacacataacggtgacatttccacatgggggcaaggagcaaatttagaagggaattatatatttcaaaaagcagctaattcagaccgagatataaagcaagacattgaatatacaaaaggcaaggaaagctatgaccgtgtcatgaaatggatgcctacatcattcaaatataaaggatctgaaattcagcgatatggtttaattgctcaggatctagctaaaatcgatctggaatatgttaagttggttcctggaaatcccattatcgaaacggtaatgaaaaatagtgataaagaagaagcagagatacctacctcagtaattgttgattatcaagatgatacactagctcttgatacaaatgttatgttagctgacatggcctgcgcgatggtattcatgggaaacaagattgaggaaatggaagccaaaattgaaagactattaaagaaacagtagttgataagaattttctatcgcacacttttacaatgcaacgatacttttgaaagtcagtctttgagggaaacgtgtgcgatagtttacttttttatttttcttccagttctttgaccctgcgaagtaattgctgcactaccggaacaagataagccgccgctgtttcagcaacattaacaatcatgccgtcctcgatcataccgcctccatcaacatccatcagcggcgaccgttctatgagttcggggaaccgctcataaatatcctgcgcccgaaaacccactctcattgcatcgggggtccacttcagtgaataaacgatagattcccactcactgataaatgcaatcgcctcctgttcagtaatcacccttttttcatttttaacgcgaatatcagaaacaccgggggtaaaggttcctgcatgagaagtgatagcaccggaaccattctggaatttccagtatttcgtataattatttccgtcagttgaaatcaaggctggccctgaatttgttgctgttccgtcagccccaatggagtaacagaaagaggtgtacatcgtcagaccgttgtgcatggttttcgcagtaacagctttattgttataagaaacgttagatccagcatccagcgtaacgattaacgccttatcaggtacccactgatcacgcatgatcgtagtcgtgaggcctgttgccgatgtaatgtcggtattcattccggatgcggctaaaccga

SEQ ID NO: 13 - DNA, 1641 bp, Enterobacter sp SA187
gacgctaaatgaataccaagtctctggagtgaacatacgtaattcattacgaagtttaattcacgagcatcaaacttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaacctgccttgcagtg
